United States Patent 12,509,677 (PROBIOTIC STRAINS HAVING INCREASED STORAGE STABILITY) - sequence listing, part 2

SEQ ID NO: 2 - DNA, 1830060 bp, Lactobacillus acidophilus
acgagtactggctggcgggcggggttcccggcgccccgcccagttggaagctgacggtgtacggggtggcgtacgtgtaacgcagggtgaccgtgccggactggtatctggggttggcgatgttgccgttcacgtcgaggccgtcgagatggtaggcgacggtcacggtgacggcgcccggggcatgcgtgggcacgtgcatgtcccaggcgccggtggcggggttgacggtcttccgggtgacgcttgccccgtcgaacgtgacgccgtcgatcacataccggggcatgagcaccggcccgggcttgctgtggtcgttggtggtgccgtcgcccagctgaccgaaccggttgtctccccagctgtaggtgtggccgtccgagccgatggccaggctgtaccagccgcctgtgctgatttgggtgaaggtcacgccggttggcggggtcacgagcacgggccggccgcggttggtgggggtgccgtcgcccagctggccgaactggttgtctccccatgcgtaggtgttgccgttcgagccgatggccaagctttgaccgtcgcctgtgctgatttgggtgaaggtcacgccggttggcgcgatcacttgcgcgggcgtgctgctgcggtgtcgggtggtgtcgccgtcgcccagttcgccggcgctgctccacccccatgcgtaggttttgccgtccgagccgagggccaggctgtgccagccggacgcgttgatttggttgaagcgcacgccggttggcgtgttcacgcgcgcgggcaggccgcggttgttggtggtgttgtcgcccagctggccgtagtagttccatccccaggcgtacgtgtggccgtccgagccgagggccaggctgtgccacatgcctgcgttgatttgggtgaaggtcacgccggttggcgtgtgcacgcgcactggtttgttgctgttgctaccggtttcgtcgcccagctggccgtaagtgttgtctccccaggcgtaggtgttgccgtccgagccgatggccaagctgtgctcgccgcctgcgttgatttgggtgaaggtcacgccggttggcgtgtgcacgcgcactggtttgttgctgttgctaccggtttcgttgcccagctggccgtgctggttgtttccccaggcgtaggtgttgccgtccgtgccgatcgccaggctgtgataggtgcccgcgttgatttgggtgaagcgcacgccggctggcgtgtgcacgcgtacgggctggctgttctgggtgttgccgtcgcccagctggccgtaagtgttgtatccccaggcgtaggtgttgccgtccgagccgatcgccaagctgtgccagccgcctgcgctgattcgggtgaagcgcacgttggtgggcggggctgggggtgtgagggtggcggtggcgtcttggttggcggggcctttggtgggggacagggtgaagccgtccacggtttgcgaggcgggggctcctgatcgggtcaggtggtcgggttcagcgcgggcgggtcggatgctggaattgacagcccccccccccaggaggatcatggccagggccgcgaatgcggcgctggcggcgcggaaacgactcatcacccctccaaaacaggcccagggggcgcgacgtggcgcctgggccgtgacgaaactcgcctgtgttgattgctggttgggacgcggcggacccggctccccgaccgatccgaacgcgcgaaaaccccttcgctggcctcccagtatagcagccaaaccactcaacaaaaacgggcaggggcgggccatgcgcgctccttgcccggctgtgagtcccaagggcgcgccagccattggtaagctctaagcatgatagagattcagcggttgaccaagcggtttggcgcgaagagagccatcgacggcgtgtcgttcgtcgctcaggacggcaaggtcactggcttcctggggcccaacggggcaggcaaatccaccaccatgcgcgcggccctggggctgattcgaccggactcgggcgtggccctgattgacgggcgccccttcgcttccatgcgttcgcccctgcgcgaggtgggcgccgtgctgaacccgcgctcggcccacaaggggcggaccgcccgcgcccacttgctggccctggccctgagcaacggcattccggcgaagcgggtggaccaggtgatggatatagccggcctcgcctccgtgggcaagacgaagacgggcgccttctccctgggcatgagccagcggctctcaatcgcggccgccctgctgggcgaccctcacaatctgattctcgacgaaccggtcaacgggctggacccggagggcgtggtttgggtgcgccagctctgccgctactacgccagccaggggcgggccgtgctcctaagctcccacctgatgagtgaggtggcgcaaaccgccgacgacctggtgatcatcgggcgggggagggtactggagcgcagctcggtggccgacttcctcgccaagcactccacgcgctccgtccgcatcgtcacgcccgaagccggcaggctgagcgccctgctggacaacgccacgcacgggcaggcgcatgtggaggccctgccggcccagagcgccctgcccgctggggcgcaagccttgcgggtgaccggcatcgatctggcgcgattggcgcggctggtcgcaacccatcaaatcgtgatttacgagctcgcccaggagcgggcttcgctggaggaggcctacatggccctgacccggggttccgaggagtaccgcgcgggtgggctcacctggcctggagcttcggctcccgggcctgggcttgggcccgggccgtcagctggcgggcctggagcttgggcaccggggcctacacctggtcagggcgctgcgctccccgggccggggcggggccggcacgcggctcagcccacggcttggacgccgctgatgcaagggccatccgctccggttgcgcccgagcttggaggagctcctggccgaggtcggagtcgcggagacgcccgcaccatgcgccagggcgtcgctcaagcgcccggtcggcaccgacggccaggaccgcccgtcgccgccaaccccgtcgccactagtcccggcacgcccagctcggcccgccatcgcaagccccagggccagtccttgccgggactggtcgccgatcccgaggccccggcccactaccatgtgccgcccctgcccactgcggtgacccaaaccgggatagcacgcccgcaaaccgcctggctgcaggcggcgcaagggctgcggtttggtggggtgaaaagccctaaccgcttgcaagaaggaggcgcccggtgagacgcgccgcagcacatacccgtcccctgcacgcagctgcggtcgcagggccggccgacaggccggtttccgaggcggtccccaggccgtcggcagcgcccgcggcgcctggactgggggtcggcggacgccaggccgtaaaccgacccattcctgatgtttcgcccatgagcatggctccgatgcatgttcaaccccggccgcaggccgccgctcagaccgcctcccgtgtttcccctggagccttcgggcgggtccctatgcaggctccgagccaaggcccggaccaaggtcctgcgcagggttcgggtcggattcccgcccagatgccggcgcggggctcagcatgggcgcgggcgcggggccaggctcagccagcgagccaaggcgctgccgggccggtctaccaggtgagcctgatgcacagcgtcaagagcgaattcgtcaaactgacctcgctggtctccacctggatcctactggccatcaacctggtcctcctgcccttgggcggcggcatgagcgcctgggccctgaagatcatggcggggaccaatccgaagaacggtaaaccgctcgccgtccccgcccccgtgggctgggacgacctgtggaccagcgtcagctccatgactggcacctgcgtaatcgtgatgggcgttttcggggtcatggccgtcaccgccgagttcaccacgtcctcggtggactccaccctgtccgctaaccctcaccgggggatgatggtgggcgccaaggcggtcgtcgccgccgcgctcgcctgggcctccagccaaatcggcgtcctgctctcgctgggcctgacccgcctggtcctttccccgctcgccctcacccccctgggcgaggggcgaggcgccctgccttgggtcagcctcttgggcgcaccggccctgatcggcgcgttcaccgtgctcgctgtgggcctcggcgccctgtgccggtccacggtggccggagtcgtcgtgctgatcggcttgcagatggtcctgccgggcctgctgagcgtcttctcctccatcagccgcttgctgaattggatgggcaccatcgccagcctgctgccgacccagctgatcagtgactgccttgcggccggcctcaaccagccatcaggctcggccgtccctggcgtcttccacccctcctggtggcagtcgggcctgatcatgctggtctgggcggccgccttctacaccgccggtctggtcgctatgcgcagccgggacatcaagtagaccaaggggtttgcgactttcggtccagcccgtgcgcgtgtcagccgaaacgcatagtatgggagctatgcctacatttacacgcgaacagatcgagcacttgggcgacctggcccgaatcgccctgaccgacgaggagatagagcgcctcaagggcgagctcaacgtcatagcagagtccatcgccaaggtgcaggaagtggccggtgacgacgtgccgcccacagccaacccgattccgttggaggcctacctgcggcccgacgagcccgaggagcccctgacccaggccgaagccctcgcgggcgcgcccaaggccgaggcgggcatgttcgtggccccgcgcatcctaggggaggagtgagcgatgagcgcagcgaatgaagagctggtcaggctgtccgccacgcagatggcggcgaagatacgagccaaagaggtctcctcgtgcgagctggtcgaggccgagctgagcgtgatcgacgcggccgagcccagcgtcgacgccttcctggaagtctcccgggaccaggccctggagcaggcggacgcgctcgacaagcgcatcgccgccggcgacaccgaaggcctgccggagctggcgggcgtgccgatcgcgattaaagatatgatcgtgacccgaggcatccccaccacggccgcctccaagattctggaaggctgggtgcccccctacgacgcgacagtcgtcgagaagctcaaggccgcgggcatgcccatcttgggcaagaccaacctggacgagttcgcccaggggtcttccactgagcactccgccttcaagcccacccgcaatccttgggacaccgggcgcgtgcctggcggctccggcggcggctcggcttcggccgtgggcgccttcgaggccccgctggccctgggcaccgacaccggcggctccatccgccagccctcggccctgaccggcaccgtcggcgttaagcccacctacggcggcgtctcccgctacggggccatcgccatggcttcctccctggaccaaatcggcccggtctcccgctccgtgcttgacgccgccctcctccaagaggtcatcggcggctacgacaagcgtgactccacgtcgattcccaagcctgtcccgcccctggcccaagccgcccgcgaaggcgccaagatggatctgaagggcatgaaggtcggcctggtcaaggaactctccggcgacggctaccagcccggcgtcgaggcccgcttcaacgagggcgtgaagctcctgcaagacatgggcgccgaggtcgtggaggtctcctgcccccacttctcctacgcactggccgcttactacatcatcatgccttcggaggtctcctccaacctggcccgctacgacggcatgcgctacgggctgcgggtcatgcccggcgaaggcgtggagcagaccgcggcgaacatgatggccgccacgcgcgaggccggattcggcgatgaggtcaagcgtcgcatcatcctgggcatctacgccctctcggctggctactacgacgcttggtacggctccgcgcagaaagtgcgcacgctgatcatccgcgacttcgagcaggccttccagaaggccgacgtgctggtctccccggcctcccccaccaccgctttcaagttcggcgagcgcatgagcgacccgctgtccatgtatctgagcgatgtggcgacgattcccgcgaacatggcgggttcgccggccatgtccatcccggctgggctctcggacgacggcctgccggtcggcttccagttcttcgccccgcagatgcgcgacgaagtcatgtacaagccggccgcggccctggaggcggccctgcaagcccagtggggcgggcccatccaccagagcttgaagaccccctggctggctggcgagtaggcatcggaaggaatccatacaatggctgagaaactgatgaagtacgccgatgccgtggccaagtacgagcccgtcttcggcctggaagtccacgtggagctgagcaccaacaccaagctcttctgccccgcccatatcgagttcggcggcgagcccaactcgcagctgaccccggtctccctaggccttcccggttccctgccggtggtcaacaagaaggccatagactacgcggtcaagctgggcctggccctgcactgcgatatagccgagtggagccagttcgcgcgcaagaactacttctacccggacatgccccgcgactaccagatctcgcaatacgacaagcccctgaacggcgaaggctacctggacgtggagctggacgacggctccatcttccggatggacatcgagcgggcgcacgtcgaggacgatgccggtaagaacacccatgtgggcggttccgacggccgcatcgagggcgctgaccactcgctggtggactacaaccgcgcaggcgtgcccctggtcgagatcgtgaccaagcccatcgaaggcgcaggcgcgcgcacccctgaggtggcgggcgcatacgtacgggccatccgcgacatcgtgcgagccttgggcatctcccacgcccgcatggagcagggcaacatgcgcgccgacgtgaacgtgtccctgcacaagccgggcgagcccctgggcaccaggtccgagaccaagaacgtcaacaccttcaagggcatcgagaagacgctgacctacgagattcgccggcaggccgcgattctggaggacggcggcgagatcctgcaggagacccgccattgggacgaggccaagcaggccacggctggcgggcgcgtcaagtccgacgcgaacgattaccgctacttccccgaccccgacctggtgatggtgcatgtgacgcgcgagcacatcgaggagctggccaaggacctgcccgagatgccgcgcgagcgccgggctcgactcaagcaggagtggggcttcaccgacctgcagatgcgtgacgcggtcaatgccgacgccctggacttgatcgaggagaccatcgaagccggggccagcccgtccggcgcccgcaagtggtggatgggcgaaatctcacgcgaggccaacgaacggggcgtgagcctgcaagagctgccgatcggcccccaggacgtggccgaggtggaagggctgatccagtcaggcaagctcaacgacaaactggccaagcagaccgtctccggggtgctggctggcgaaggcaagccggctgaggtcgtggccaagcacggctaccaggtggtctccgatgacggagcgctcgaggcggccgttgatgaggcgctgaaggccaacccagacatcgctgccaagctcaagtccggcaacatgaagcccatgggcgccatcatcggcgcggtcatgcgcgccaccaagggccaggccgacgccaaggcggtcagcaagattgtgatgcagcgcatcgcaaagtgaagacgcccccgcgcgctccccgatggtcgtgaggggcgcgctggactgtcagccgcccgcccctaggggtggcggttttggaggtgacaagatgtcgggtgcggacgcgcgcggggtcctacaggagccggagggtcggcaggtcgagcgggagttgcccagccggattgacatcccctatatcaacggggagatggtccacctgcgcccggcgacgatcgctgatttgacgcgcatggatgagttgcaggctttttacaactccacgggaatcaccggcaaggggcccgaggccgagcgggcggtcgtcaacgcctgggtacgtcggtcggtggcctggtccaagggccagacgccgcgcgaatccggtgtgggcgatcctgaatccaggcgtacggtggcctgggccatgatcaccgaggccgaccacgacaaggacggggccaccgacgcaagcgccaccgatggcgtcatcggcatgattttcctgattgacgtcgacggctggtcgcgctcggcccgcatccaggtagtcttgggcagggactaccggggtcggggttactctcgcgacgccatgcccagggtgatgacctacggctacgcagcccggcccgcaggcttaggcctgcaccgcatctgggtggccgtgccggagaagaacacccgctcgatttccgtctaccaatccctgggattcatggtctcaggcacctcccgtgacgccctgtgggacgagcagggcggcaagtaccaggaccagatagtcatggatgcactggtcgacgaatacgatcccatccgctccctggacgctttcggaatgcacgtgattgagggcaaccccggcgtggccgaggcgctggtcaaccaccgacgggccctggagtccggtgaggtggcggacctcgcggtcgaggaggccgtggcgcagtccgaggaagaacgccggaaggccaggcgggcgcaactagcgggcgccaaggccagggcgcgcgccaaagccgaagcgggggcggaagctgaagctgaagcggacgcccaagcccgcgtcccaggtcaggaccaactccaagcgcaggagagcacgcagaccagcgggtctggggacgatggggctgcgggcgtcgaggctgagctaagcgggggcgaccctcaggccaccgtccaggagcctggccgggagcggtccgccgcccccgaagagggcgggcaagagacgacgggctcgggggagcctcaagaggagccaggggagccagtggaaccggcgtcgcaagacgacgccaccacctgggcttattcggactccagccgaaagaagggctccaagcaggcctggtggcgcaacttgggccacggcggcaagcgaaacgcgggaggcaagagttgagcgctgaggatttagacaactacgagaccgacgccgagctggccctctaccgggagtaccgtgacgtcatcaagctcttcacctacgtggtggagaccgagcggcgcttctacctggcgaacaaggtggatttcaatgtgcgctccgccggtcaagacgtctatttcgacgtgcagctgaccgatgcctgggtttgggacgtctaccgttcctcccgtttcgtcaagaaagtgcgcatcgttaccttcaaagacgtgaacgtggaagaagtgcagaaaagcgacatcgacatacctgactcgctgtaggtgctgctaacgtggcccaatgtacgtttttcggtctatgcaggctcttcaatcggtgagagtatcgtaagaccgtccaacaaccggcctacaaggctggtgagcgtacgccgtgccatgcttttcaggaggtcaacatatggtgcacaagcagtccgtcgtcatcgtcggaggcggccctgcggggctgacagcggcctgggagctcgtcaaggacggcggcgaccagcgttacgatgtgactgtgctggaggccagcgataccttcggtggtatctcgcgtactgtgcgccacaagggcaaccgcatggacatcggcggccaccgcttcttctccaaggaccagcggatcatggactggtggaaggacgtgctgcccctgcaaggcgccccctcctacgacgacaagaagctgggtcgccaccacgacctggagcccggtgggccggacccggagaagaccgacagggtgatgctcaagcgccaccgtgtctcgcgcatctactggaaccgccacttcctgggctatccgatctccctgtcgccccgcctgttcaaggcgctgggcctcaagatcacgctccaggccggcttctcctacctggcttcgatcttccataagctgcccgaggacaacctggagaacttttacatcaatcgttttgggcgcaaactctattcgatgttcttcgagggctacaccgagaagctctggggccgtcacccgcgcgagatttccgcagactggggcgctcagcgggtcaaagggctgagcattatcgccgtcctcaagaacgccttccagaagatggttcccaggaagcgcgactccagcaaggtggagacctcgctgatcgaggagttctggtaccccaagctggggccgggccaactgtgggagaccgtggagcggcgcaacgtggaacacggcgtgaaagtgatcacagacgcgaccgtggtcgaggtcgatcaagaggccggggcgatcagcggcgtggtctacaaggataaggacggcaaacgggtcagtctgcacgccgaccagttcatctcctcgatgccggtcaaggacctggtcaacgcgatcagcgcctccccggatggtgcccccgacgacatggtgaaggtggctaacggcttgccctaccgtgatttcgtgaccgtaggcctactgatcaagcacctgcgcatccgcaacaccacttcgatccccacccttggccatccgccgatcgtgccggactgctggatttatgtgcaggacccgggctacaagatgggccgcttccagatcttcaacaactggagcccctacatggtcgaaaagccggacgatacggtctggatcggcctggagtacttctgcgaggagggcgacgatttctggaacatgtccgacgaggaggccaccgctttcgccatcaaggagctgacccgcatgggcgtgatcggcggcgcccgcgatgtgatggactcccaccgcgagcgggtcaagaaggcctaccccgcctacttcgacacctacgaccgcatgcctgagctgatcgagtggctcgactccttcggcaacctctactgcgtggggcgcaacggccagcaccactacaacaaccaggaccattcgatggctacgtcgatggaagcggtgaagaacatcaagaccggtcgcacttccaagaccaatgtgtggaatgtgaacaccgagaagtcctaccacgagcaaaagtaaaccctgagggcgcggttcgtgtgcgcccttcggggctgcaagctgaaaagcggtcggtggcgtagcgctaccggccgctttcgcgtttccggacccttgtttctgtgcgcggcgcggcgtgtttgcgtctgactagagggcgttgtaggcttagattagttcggtttgctgggatagctacgaacattcataggcggttcatccgccaacttcttgaagtcgcatgctgggattctgggttgtgcggcggtaggaaaggcaatattacagtggcaacgagccaagatattcataccatgaagctgcctgagctcagagaacttgccaagcagctgggtctgcgcggcatctctggcatgcggaagaacgcgctgatcgacacgattgaggcggcgcgctccggtggcgagccccccgcaggcgtatccgtccgacccgtggccaaggcttcggcttccaagaccgagtccgaacggtccgctgagaacgggccccttcctccgaccgagagcgcggcgcagacgacgacggtgtcggatgccaagctggacgctgacgaagttcgagggcgtgagccccagggctcagccaagggccaggtgggcgatttgttcgacgctctgggaatcgacgagggcgttggccgccggtcacgcgctgaccgcgccgagcgttccgaccgcgcggagcacacggtggccgatgacgaatcggtcatcatcaaccgccgccgtcaccgttccggggactcccacacccgtggccggggccgcgacgagcgcgacgaccgcagtcgcgagcgcgacaggggcagccgcgaccacagcaaggtgcgcgatctggatgacatcctggccgccttgcctgcgcgagagaatcggcccacccgcaataagcggaaccgtgacgagcatgaacgcgactaccggcacaacagttatgaccgccatgaccacgaggggcgcgctgaccgctccggccgtgatgaccgtcggggccgcaaggaccgccgttccaaccgcgactatgaggctcgtgagagccgggatgacttcaggaacgaggacttggtgcccgtggcgggcatcgtcgacgtgctggattcgtacgccttcatccgcacttccggctacctgcccggccccaacgacgtgtatgtatcgataggccaggtcaagaaatacggcctgcgcaagggcgacgccgtccaaggcaccactcggcctccccgcgagggcgagcggcgcaaccagcggcagaagttcatgcccctgcagtccattgagacggtcaacggcatgagcgtggaagaagcgatcgaacgcccccacttcaacaagctcacccccctctacccgcaggagcgcatgcggatggagacgacctccaaccaaatcaccggccgtctgatcgacatcgtggccccgatcggcaagggccagcgcggactgatcgtctccccgcccaaggctggcaagacgatcaccttgcagaatatcgccaatgcgatcgccaagaacaacccggaggtccacctgatggtggtcctggtggacgagcgtcccgaggaagtcaccgacatggagcgcacggtccagggcgaggtcatctcctccaccttcgaccgtcccgccgccgaccacacgaccgtggctgagctggccatcgagcgcgctaagcgcctggtggagctgggccaggacgtggtggtcctgctggattcgatgacccgtctggcccgcgcttacaacatcgcggcacccgcctcgggtcacatcctctccggcggcgtggacgcccaggcgctctacccgcccaagcgcttcttcggcgccgcccgcaacatcgagaacggcggctccctgacaatcatctcctcggcgttggtggagaccggctccaagatggacgaggtcatcttcgaggagttcaagggtaccggcaacatggagctgcgtctgtcccgcgagctggccgacaagcgcatgttccccgccatcgacatcaacgcctccggcacccgccgcgaggaactgatcaccgcgcccgacgaattggctgtggtctaccgcctccgtcgcctcctgggcggcatggagatcgagcaggcctaccagactctggtcccacgcttgaagaagaccccgaccaaccgggacttcctcggtgccatcacccagaccatgctggggcagcagaagtaagctgaacgccgcgacttcgcggctgaggttttgaggggaggggccgagacgctgatgcgtttcggcccctcctcggtatgcgcaggccgctccagccgccggaccggcggctggagcggtaggatcaatcagtcgaattcgatgacttggcgtaaggcctggcctcggtccagctcatccatcgcttcgttaatgtcgtccaaccggatatggttactgatgagtttctcgaccggcagcttgccgtccaaccacaattgggcgtaacgggggatgtcgttggcaggcacggccgaaccgaggtagctgccgatgatggtgtgcgcttcgccagtgattacgctggagggcaggctgacccgcgtcgtcggcttagggaagcctacggtgatggtcttgccgcccatcgccgtcaagtcgaacgcctggtccagcaccccgggcgcgccggcggcctcaatcacgatcggtgccttgacgcccttgttgatcgcttcctcgaccgtatacacgtcggtggcgcccatgctcagggcatcgtcgaatttggccttgttgatatccacgccaattacgcgcccacgacccaaagccgcggcggtcaggatggcgctcatgccgaccccgcccaggcccagcaccatcacatcctgcgcatcctgggggtcgccggcgttcaaaaccgccccgcctccggtgagcacatcgcagcccagaacggccgctatggccttagggagctctgcggggaccggaacgaccgaccggcggtccactacggcgtaggtggcgaatccagacacgcccaagtgatggtaaacgggttcctcacccctgtgcaggcggatgccaccgttcatcagggtgccggcctggttggcttcagacccgggaatgcagggcaggcggccgccggtcaggcagttggcgcacttgccgcagcggggcaggaaggcgagggtgacgtgctggccgaccgacagaccttccacaccgggccccagctcctggatgatgcccgtgttctcatggcccagcagcatcggtgtggggcgtggtctggagccgttcacgaccgaaagatccgaatggcagatgccggatgccgtgaccttgaccagcacttcgtcgcgctgggggcgtccagctcaagttgttcgaccgtcaacggacgtgactgagcatatggcttaggcgcttccatggcgttgagcacggcgccggtgacttccatgtgactgctctctttcctgctgttgtatcttgtgccgcctgtgagtggatgacgtcctgttgttcccccgctgaagcgctttccccgccgcgctctccgtcagtacccacttcacaaaatagtgcaaggcgcggcttaggggaggtgggggatggcttgccgccagtgcttaggaaaagttcaggtccccatctggcgtagagccaaatggggacctgactgatcggaattcgaggttcagtagccggtcactgcttgcgtggcttcttggctggaggttcgcccagctcgctctgcgccacttgcacggctgaggtggactcgccctcgccgttttcggcgccggttgcccccttgctcagggaggcgtcctcgaccgcttcaatcggcccggtcattcggcctgcttgggcgatgtcgtccagggccgccttgaccgcttccaagccctcaggcgctacggccagtttggcggagaggatcggggtcttcatcgacaccttggcctcggacttgatcttgcgcagctcggctagggcgtcgcccgcccaggtcaggaggtcgggggagacgccggcagcggcggcccggtaggcttcagcggtgggccaggaggccctgtgaaccgaaccagacccctcgtgcatccactgccagacctcttccgtggcgaagggcaggaagggcgcgaagagacgggcgaaggcgtccagggccaggcccagcgtggtccgggctgagcggacgtcggcctcgtcaggctccacgccctgatcgtccggcttgccataagcgcggttcttggccagctcgatatagtcgtcgcagaaattccagaagaaggactcgattacttccaaggccttggagtgctcgtaggcttccagagactgggtggcctcatcgaccacttgcgccaagcgggccatcacggccctatccagggctacggtcacatctgccgggtcccaggaggcttgggcgggctgccctacgtgatggttctcgtcttctcggccaatcgaaagcgcgaacttgctggcattgagcagcttgatggccaggcggcggccaatcttcatctgcccctcgtcgtaggtggcgtccaggcctagccgggcgcaggaggcccagtagcgcaccgcatcggctccgtactgcttaatcggctggtcgggaacgaccacgttgcccttggacttggacatctttttgtggtccgggtccagaatccaccccgaaagcgtggcgtgcttccagggcaggcagccgttctccaagtgagcacggtccaccgaggagaaaagccaggtgcggatgatgtcctggccctgggggcgcaggtccatcgggaaggtggccttgaagaggtcctggctggcttggtccggttcggcccaatgggtgacgatctgcggggtcagcgaggaggtggcccaggtgtccatgatgtccttctcggctgtgaaaccgccgggttggtcacgctgggattcgtcgaagccttcgggcgcgtcgatcgaagggtcaatcggcagccggtcctcggccggggtgattgggtgggcgaagtcggtttccccgtcctctccgaccggataccacagggggaaggggacgccgaagaagcgctggcgggagattagccagtccccgttgagcccgctcacccagttgtcatagcgcacccgcatgaacccggggtggaaattcagctccttgccgcgctcgatcagctcagcgttcagcttggcgtcggtgcccccattcttcaagtaccactggcgggaggtgacgatctccaggggcttgtcgcccttttcgtagaagttggtcatgcgcttggtgagcttgggctccccgtccaagtcgcctgactcccgcaaggcgtcaacgatcatcttgcgggccgtgaacgtggtcttgccttcgatcgacttgaagagcgcccgaccgtcctggtcctcgatccagtccggcgtgaacatgatgatgcgcccattgcgttggatgattgaacgggtgggcagcttcaagtcccgccaccattcgacatcggtcacatcgccgaaggtgcagcacatggcgatgccggcgcccttgtccatttcagccgccggatgggccaggattggcacctccaccttgaacaagggggagtagaccttctggccgaagtagggttggtagcgcttgtcgtcggggtgggcgatcagggctccgcaggccgcaagcagctccgggcgcgtggtctcgatgtatataggggtgccatcggcgaagcggaaggccacgcggtggtagaaaccgtcgtactcgcggctctccagctcggcttgggccacggccgtctggaaggtcacgtcccacaggcccggagcctcctgctggtaggcctcgccgcgcttaagattgcgcaggaaggccttctgcgccactcgacgaggtcgttcgccgattgtgtggtaggtctgcgaccagtcgaccgacaggcccaaggagcgccagagccgttcgaagagctgctcgtcctcggccgagagccgttcgcacagttcgatgaagttccgccgtgagatgggcacctggtccttggcttggatcttcttgccctcggtgccctcgaagggcggcttgaagtcggggtcgtacttgagcgaggtgtccacgcgcacgccgtaatagttttgcacccggcgctcggtgggcaggccgttgtcgtcccagcccatcgggtagaacacgtcgaagccgcgcatacgcttgaaacgggcgatgacgtcggtgtgcgtgtaggagaagacatgccccacgtgcaagtgtccggagaccgtggggggcggggtgtcgatcgagtagaccgactcgcggtcgcggctttcgccgaacttataggtgccggcctgttcccagcgctcgctccacttatcttccaacccatccacacccacccggtcgggcaggggggtcagcttagcttctacggttccttggcgttttgacataggcccagtttatgggcgaacgctgacaagcgcgcgtccgcatccgcaatgtggtcgaatgtgcctgtgcccagtcggcagtagggttcggtgcctatggaagccctgctcccttgggggcgctcagccgcggtcaatccgccaggcggccaggcggtcgtcgctcatgttctcgttcaagcctttgagccggaaggcccgcacattcaccggggtcttggcggtaagccagtcgctgggcgacttgtcagccagcgaccgggcgtactgcttgagccgggaggcgtagtcctgctcggaggacgctccagtcgccaggcggaagagctgctggcactcggggtcgtcgaagagcatggtggagttcgggtcggcgaactgggatatgtcgtcgttcgacatagtcagcagggtcagctcgtagtcgcgcttggtcataacctggtcttggaaggcggcttggtccagcatggtcacctctgcagggatgcccgcttcagccagttggtccttgacctgctgtcccacctgcccgcccagactctgctcgtagaccagacgaaggcggccgtggtagaaggaggggttgaagtagccggccagggagcgggccttggccgcgtcgtgctggaatggggcgtagcccgcgtcgtaaccggcggagaggtcgttgaccggcccgttcaacgccttggctgtgccgttggagcccgccgcgatggccggccggtccaccccatagcgcacggcctccttgaagcgctggtcggagaggatggatgtctgggaatcattgaaagccaggaccagattgctctggctgaccccggtggaggttgcgaagcccttgaggcccttggccgtgcccgcctcctgcgggctgagatccacggcggcgtcgagcttaccgtccgccacctgctgggcctggccgctggagccctccttgtacgacaggatcacggtgccaatcgccgccttgtgggggccattgtaggtcttgctgcggctcaaggtgagctcctggccgttctggtaatcctccaccgcgtaggggcccgatccggccgactggctggcgtagttgacccgggcgccgcggttgtagacgattccggcgcggcttgccaggatgcggggcaggcgggcgtcggggctcttgagctccacccgcagctcgtcggaggaggggttggtcacctgggccaggttgttcaggctctgccaccccacgtacttgttcgccaggatctgctggagggaccagagggccgcgtcggagtccagggcggagccgtcctcgaactcctcgccggcgcgcaggtggaaggtgtaggtcaggccgtccgccgagacccgccagtggtcagccacgcccggctcgggcttgccctggtcgtccaggcccaccaaggtctggtagacgttgcccaggagggcctgctccacgccctggccaggctcggtgcggatgtccaaggacccgggcgcttggcgggctccgatgcgcaccgtccctccttgttcggccaccgtccgtctctcccagcggttcacgaggggccagatgagtgcggccacaaggctcagggctacgagggtgatgaggaaggtcaggcctggcttgagtctcttgtgctgttcctgcgtcatactcctgattctaacgggccgggcccccgggtccggtgaggcgctacggcttcagccctggtcgacccgacgtccctggtggaagcggggcacttggtcggactcgactggcgcacccaggaagagctccgcggaggggcaggaggcggccagggggcagttggcgcagtcgggtttgcgggagtggcaggtgactcgtccgtggaagatgagccggtgggagaggttggtccagtcctcgggcgggaagcactcgcagatttcgcgctcgatcctgactgggtccggatgggtggagcgccagtcctcccgccagcgcaggcgggccgtgacgcgggtcacgtgggtgtccactgggaagccggggatgccgaacgcgttgcctagcaccacgtttgcggtcttgcggcccacgccaggcagtttgaccagctcgtccatggccgccggcacctggccttggtagtcgtccaccagcatctgggacaggccgatcaggtggacggctttggcgtggtaaaaaccgacgggatggatgatggcttccacctcgcccaggtctgctccggccagggccttggcgtcgggaaagcgtcggaaaagttctggagtgaccgtattgacccgcttgtcggtggtttgggcgctcaggaccgtggctaccaggagctcgaaggcgtcacggtggtccagggcgcagaccgcgtcggggaactcctcgcataggatctcatactcttggtgcattcgctggattcgggagcgcttgccctcccgccagctgccgggatgtttcgctgccgtcgccgctgctgccatgcgtttcacaccgtctttccgcccccgtgcccactgttagcgtgagggtgcttgcttcgcgacgccttgtgggtctgccggtccgggggcgtcgtgtcctgcgtcggctcctggcctcccttgggcgtttggcgcccgctgccatctttgcccggctcctgcccgtcagtatcggcggggtcgaaccggtagcccacattgcgcactgtgccgatcagatgctcgtactcaccgcccaacttggcgcgcaagcggcggatgtgcacgtccacggtgcgggtgccgccgtaatagtcatacccccatacctcttggaggagctgggcgcgggtgaagacccgacccggatgctgcaccaagtatttgagcagctcgaactccttgtaggccaggtcaatcggctggccgcgcaggcgggccgtgtagccgtccgtgtccaccagcaggtcgccggcgcggatttgcccttcctcaggctccggttccgcttggctggcggcagggatgggagcggagggatgggagcgcctgcccccttcgatgaccagtcgcagacgcgcttccacttcggctggggacgcggtgcgcaccacgatgtccgtcagcccccagtcccggttgacgacggtgaaaccgccttcgctcagtaccaggatgaccggcgtgcccaggcctgaggctctcatcaggctgcacagggtcttggcggaggccaggtcgtcgcaggcgtcaacgaagagtatggtgtcctccggcattttgaccagggagtcggcatccagcggaagcacgcggacgcgataggaaagcaaagccaaggcgggcagcacagtagcggggtccttagcaaaggtcatcagcgtcaaatccgtcacggccttaccctcctcccgccttgcgtgcggccctcttcagggtgtgggactcattgtacagtcgggtatgtcgaagtggttcgattacgaaggccgacagccaaaagtggggaaggcagggtagattagtcttgtcggttcgggatacgccggccccggctttggaaggcaatggctggggattgaacttcgtggaggcttataacgatgggcggtaaaggcggaaagcacgcgcgcgtaggcacagggcccacgagcgggggtgattcccgtaagcgctccccccggcggcgcggccatcacgctgcgctcaagcctggcattccactgacccaagccctgcttttgctcgtgctcctgctgccttcggttctggcccgctccccgttcggctccgagtcgctgatctcggtcgctaatttgctctgcctaggtgtggcagtgatctgcctttccgcctattcccttgcccgaggcggggccgatagcctgttcgacagcctctttcccttcatcctgggagcggcctcattgattggcgcctgctattggaacatgatcgctgtggtcagcgggagcgaaggtttggatgcgcagtgggccgtgttggacaagtgggtggacctggcttgcctgctgttgattctcctggtggttctcgctttcggtcggcagatgctccgtttgaaccgtacggaggtgattcgtggcctgtcggccaacgttatcagcggtctgacctgcatttgcgtgcctggctggattttcctgccttcgctgatgtcccacctatcggtggacctgcccgctggactgggcgatcggaaggccttgctctgctcgctggccgtgctggtcgccctggtcctggccgtcggcttgtgcgccgcctcctggggctggtgggttgacctgggggccaggaggcggcgcgaggcccagtcctggctggctatcgcgttgattccgatgatgctggccggggggctggtggtcgtcgccctctacaccgttcacctgttgggctaggcccggtacgcacagcctccccggccctggtccgggttgctggtactgattaccggccggagtaggtgaccacgtcgagcttctggtcctggtatttggcgaggaagacgtcgctgaccctcttgacgccttgctccttgagcttgccctccagccattcttcgtcgcggtccatcagctccagcacgtccgggttggtcctgccgtccacgatgactgggtagcgcacatccttatcgcccttgtgcagaatcgtcagggagccgttctgctcaacgatcgcccgctgcacgtcgtggatgtcggagaccccgccggtgcgcagcttgaagtccacttccttggcggtcaggtggactttcaagcagtttttgaccaggagctggccgtctttgacgattgtgaccggctcgccgtctatgtacttgccgaccgcgtggatgtgggtcttggcgtagcgggtgatgaggatcagcgaggcccaaatcagcaggatcacgatgtactgggccattgtgatcgtgctgctgtaaatcacgccgccgataatgccgcccagcacgtagttctgcaactggtcggtcggtgaggtcggagccaggttgcctttgccggtcacgttgatcagcagggtgatgaagagcaggccgataatcagcttggccgccacctcgatatagaagttgatgtccacggctactcccctttcactgtgatgtcaggctcgtaaaggttggctttgaccaacaggaattccgagccggagccgttaaagaccagcgagtagtagcccttgggggttttaaccagcatattgttgttgcgcgaggtgtcgttgatggctactgaatgcgggtccacccccagtttcttcgcggatttctcgatgaccaccgtcaattgcccgctctgcacgctggctgtgcgcaagttggtgaaatccgagtactggatcgcgaccgccagcagcaggagggtgcccaatatgatcgagaggtccttgtacttcatgtcccacttattgcgggtgtacttgaccataaagactaaaaaggccaaggccagcaaggcgatcaccacgatcttggcgatcgcccagttggtctggcccccctttaagtagtcataggtatagaaggtcatgtgctgttcgccgtccttaaaggctgaatacgcctacagggcaattgtaggacggccctacccccagattgcccccaggggccagcgttcgcgttcgccgcggctgtgagcgctcacgacaggtagcgcttgaaaagctccttgtacaagtgggtgaagtccaggtacatagccttggaaacccactcgttgtcttggtgctgggtacctgagccgggaccgaacatcaggtagtcgaagccaatcggctggtcgatcaggaacttggagccgtcggtgccgcctgagacgcccaaggtcaccaggtcggtcttggagaagggggcgcctaccgccttggacagggcacgggccttgcgctcgccctcctcggtccattcgactttggccatgtagggcttggccacttcctgggccagcttgatcagtttggagtccacgttgccgatgatcggcacgatgtccatgtccacatccatgctcacgtgcgcctggctggaggcgttgaaggagtcgatgacttcattgatggtcttgaggatgacctcgttgtcgaactcgggaatcgtgcggatgttaatctccgcctcggcgttggcggggatggcgttgacctggttgccgccgcgaatcgtgtcgatgttgaagaccgtgccgcctagcacgtcgttgttggcggatgcgctggcctgcgccatgcgctccttgatttggtccaggacttgcagcagggcctcgaccgcgttgacgcccagggcggggatggagctgtgggccgccctcccctgcgccttgatggtcaggtccagctctcccttgttggcgtagacggccaagtagcccgagggctcgccgatcaaaagggcgtccacgcccttcatgtagcccttgcgttggaggatttccgccccctcttggccgacttcctcgccggaggtgaccaaaaacttgagtgtgcctttgagcggagcgtcttcgcgcttgagctcgatcatcgagatgatcatggccgccaggccgctcttcatgtcggtggcgccgcgcccgtaaaggctgtctccgtcatcggcctgggtcaggacgaaggggtcggtcttccagttgccccgatccacgtcgactacatccatgtggccggagatcgccaggaccggatgacccgagccgatggaggccaccaggtcggcgcgatcctcgccggtcggcacaatctcggattcgatgccctccttggcgagcagggacttgatgaattccgccaccggcagctcatgcccgttcacggattggaaggccaccagcttgcgcagcagctctaacttctcttcgtttgtcatcgaatgctccttctgcgtttccgctttagggggtcgacccccgtgctcgatcccgtcctgctcccactctatagcttttcgtgcgcttgcacgggtttgttcgcgcatgtggtcgaatgttgagcgtccagatacgccgccgccggcggggcgagggttcgggcttggcgcccataccccgtccctccggcggcggttgcggttcctccgaaggcctcagccctggtcggccaagcgcttgcgggccgcgacgatctccttgtcggcggcctcggcgttggtccagaaatcaccgggcatgacttccttgccgggctccagggccttgtactgctcgaagaagtgcttgatctcggccttgtggaagtcggacacgtcgtcgatgtccttgatgtcgtcgaaacgcacgtcggcgggcacgcacaagaccttgtcgtcgccgccggcctcgtccaccatgtggtacaggcccacggcgcggcactccaccacgcagccggggaagacggagttgggaatcatcaccagggcgtccagcgggtcgccgtcctcgcccagcgtgccctcgatatagccgtaatcgtccgggtagcccatagaggtgaacagggtgcggtccagcttgatgcggccggactcgtggtccacctcgtacttgttgcgcgaaccgcgcggaatctccaccaacacgtcgaacgtctctgccatagcctgtctccttactcctgggatttgcgcctcgcaaacccgccgacactcaccgcttactctacccaggcgcttacccaaggccgccggctcggacttatccacaagcggcgactggcggccacattcgaccacaagcctgcagcggttcgacgcggatgggcgcggctgtcagacttatccccatgcctgggcgcgcggcttaggtgggaaagggctgggtgtgttttgatagagcaagagcagtgtcggatatcagcgtatccacggacggaaaggcacggacatggacgaggacggaaggggagccgaagcggccgaagggcggcggtggtcccggggacggatgatggcgctcgctggcgcgattgtggtcgtggccctcctgctggcggccgggctgggctggtggtcgcgcgaccagtggcggcgggccctggcggactgccaacaggcggcggcgggcttatctgaacaggccaaggccagagagccagggctggtggtccaggcgcgcgcggttcaggaggggcaggtgaccaatcgcgagacgctgaccgccttgcaggcagcggtcaaagggcttgaaccggtcaaaccggaagcctgccaggtttcgcagggtgtggccgggctccgctcagccagtgagcggatgcgggatcagatgaatcggcgccagtgggccagcgtgcgggtccaacgggctgcgaaggcggtgttggcttcgcgggatgcgaagagtttggcggacgctaaggccgcgttgaaagcgaagcaggacgagggttcggcgcgtttggcgcagaccgacgggcaggtggccgatgacgccacccgtgagcggctgctgcaggcgttggacgcggcgggcaaggtctcctcctcgaagccgtccgactaccagcaggcgcaggccgccatccaggccgcgctcgaccaggtcaacgccagcgcgcaggcgaaggccgaggcggacgctcaggccgcgcaagcggctcaggcggcgccggctcaggccgtccagcagtcggccccggtccaacggtcggccccctcctacagcgggggtgggtcttcctaccggccttccgttaatcgcggcggcggctggtccgcgccagcaccggcagcgcccgccgcgccacaaggcggaggggttagcgctgatgtgaacaactggatgcatcacatgggtaatcctgtgtgccagaagggtcaggcttgtggtattggctgattgattaagaatgtgccagcggggctgattgcttggtaggtcgtcgccccgctggctgggttggacgagcacgtgtgcccgtccccttcatggtaagggaaagcatatgaagaaactggggttattgaggaatcccggcagggtgaggaagggcgtggccgtcgtttcggcggtggcggccctggccgcgttgcccgctggggtggcgttcgccggtggcggcggcggcaagtccgacggcaacggcggcggcgagatggccgcgcaggtcagttgggcgtatcaggatagtaatgatggcgcgttcgggtcggccggggatctgggcagcgtgtaccgggcgttcggccagatgggcgtgaccatgctgcccggcggcgtcggccacgcgcagcaggcgttgagcgaggctaacgcgaactgcctcgcgcgcttcaacgaggcccatcccgaccagctcaatcagggccagtgccgcgtggtgggcgtgggcgtcatgaccggcagcaacaagcaattcagcggcgaagtccaccacctgaaatccgattggctgcaaagctgggcatctatggtgcaagggcgcgtctacagcaaccacggtgtccagtattcgactgccgatcctttctttgatcagcctggtacttcggtgaattcgttggttgatgggtatacgggtgattcggtgagtacggtggtgatcgcgttgaaccagtatgagccgaagcctgcggatgtgccgccggcgccgccggcgaagacggtggagcgtggcacgagcgcggattcgatggtcaaccatacggtgatcgcgtcgggcacgggcgtcaacggcaagcagttcgtgttcagggacgcgatcgcggcgaacgggcagcggtacacggtcaacaaccagagggtcgtggacgcgacgacgggcgaggacctctccgggcggttcgcgttcaacacggcgaacgggtccacgccggccggggacaccgcgacggcgacctggaagggcgggagcatccccgacaaccatacgtggcggtacgagctggacgtgacggtgcatgggccggagaccagcggcgtcagggatgacggctcggtgtactggaagggcttctccacggaggcggaccagcgcacgcccccgggcgagttcccgacctggaagccggacccggacaagtcctgggtcttccaggacccggccagcggcaggtggcgggccgtgatcgacccgtccaagtcgaatacgaccggggcggatggtcacacgttcctggacggggaccaggtgggcgccgtggtcaacggcaccgtggacccgaacctgatcgaggctccccgcgcgttcaagctggcggatgattggggcgcggcctcgtacctggtgggccaggccgggggcgtgggcgcggtccgggtgtacgaggccgacgccgaggccgggcctgacgggcattaccggcggtccagcgtggccgacatcatcaaccagggccgggacgtgaccgcccagttcgacatcacgatgagcgcttccggcgccgtggcgtccgcgaagccatcctatttggccaagcttaagggcatgggccggccgttgcaggtgaccttgttcacgccgttcggggtgaatttcgcgcatggcaagggcgcggagcaggtgcgcaaggaccatggcaagcggcccggcgacgagctcaccttctgctcgccctcggcgggccagttgaccaggggcttcgtgcctaccggagacaaggctgacactgccgggcctgggcctatacgtcctacgcaacccgatccgggcgacgccggcccatcgccggagttcatcaacaagggttcggagacggtcaacgatcaggaggcgccgaccaacgagcccaggatctgcgggtacgtgcccccggtgaagaaggacgtggtctcggagtcaagccagggcggcgaccagtccagcgtggacggcaaggtcgtcttccccgggcagaaactggagtaccgtttgcagaccgagccgcagctgccggccgacctggcctaccagccgacgcaggtggcggtgaccgatgcgtacagccggtacctggacgtggacaagcagaccttggagatcaccgacctgacgaccggcgggttcgtgcccaagagccagtacgcgagccagtgggatgacgccgcccatgccgtgcgcctggtcttctcagacgcttatgtgcgcgctaactggaggccgggccttcatccgcgcatcatcgtgcgtttcgaggggaccgttgataagagcgcgccggccgataccaaggtggataaccagtgggggttgaccttgaacaattcgctcaccccgagcaacaaggtcgtcaacctgccaccggaccccaagcccgacaaacaggtgacccaaaaggatccctcggtcatcatcgacggcagaaccgctttgctgggcgacaaactctactatcgggtgggaatcgatgcccgtggccttgaccaggcggcctaccgggtgcagcgattgggcgtgatcgatgactatgaccaggagcacttgaaggtggacgaggcgggcatccaagttttggatgactcgggtgccgacgtgaccgccaagctcaacatccaagtcaaggacggcattgtctacgcgttcttcaggacggtggacactctggtgcccgctaccggtgagaccattaaaggcgatccgcagcccggggacctcaaggcgtacgccggccgcaagctggacccggtcaaggatcccggcattgatcagcgggtcttgggtcacagctaccagctggtcctgccggtcaccgtcatcagcgtcaaggacggctacacggtcagcaacacggccaagcaggtctccaacgaccgccaggacgtgaccaatacggtctccaaccccttaaagccggtcaatccggtcaaagatgtggtggtcacggtaggtgggggcagcatcgaccaccagaaggtatacttcaacagccagttcctctaccggttggattccagtgtgctgccggcccatcgggcgtatcccaagctgacggattggtccatcgtcgacaagtacgacaaggaccacgacaagcccaccgggcagtggtccgtctacgccaaccgggatttgaaggcggcggacgggagcctgctggccaagcgcggtcagcggatcgcgggcaagggctttgacgctaaagcgttcggcggcgggttgttcgacttcgaggatacaggcagccagctgaccataacggccagcaagcggtacttggagctggcttcgcgcgacgtggaggagcaagcctggtcagcttacgtgcagttcactcgctacaaggcctccgaatcggtcaagaactggttcactgagaccctgaacggcgttcaacgcccctccaacgaggtggagacgaagacccccgacctggtgccggccatctcggttgagaagttcgaccaggccagcggccctgcggcgggtgacaggaacgacccccaggaggccttggaggacgccaaggacgggacggtcatcgtcttccgcatcactaacacaggtcagctgccgctgacgggtttggccctgcatgatcagacggtcctcggctcggggactgtggaaggcttcgaatatccagagggcttcgatcagctggtcctcaaaccaggcgaccatgtggacgtgaccggcaggctcaagggtgtcaaggatggtgacaggcacaccgatagggctctcgccagcggcaaaccggtcgtggactgcccggttttggacgacgacccctgggacgataagcctggcacccagaagcagggcggctgcgggggagcggacgtggtctcccagccggacgactggaacgggctgaggccggcgacactggcgctgaccggttccaacgtgctggtcctcttctgcttgggtctgtccctgttcggcgccagtctgccccccctggcctttgccaggaggagacgccatcgctcaaccgaagcccaccatgccagcgcttgagccatgcggaagggtctggggccggtgctgatttcgccgccgaccccagaccctgatgtcagcctatctatcgagcggttaggccgtgctcgtcagtcttgggggagccttgttctcggagcgcctacgatcctagagaggagggcgccaatcaggtcaaaggacccgagtgtcacaagaccttccttcctggtacctgcggtgtggaagagggcatcgaaccaaaggcggacgagaagacctttgctgctgccgcgtttatgcccccccccctaaaaaagcgtatgagggccctaggccctctggtcttggattgctccaaccgcatttcccaagagctcggttacagtggcgcgtgatggttggatggcgccaattgcgctggcgaatcctctggctctgtgggctcagaagcgggagtcctcggcctgccagacccagccggggaggctttgggtaacgacccacaaggccatgctgcagcttgtatccactttcccgttccggctctgctcgaccgcccctagcaggaccttgggccgggccttgctcatggcttcctcgatgtcgcccagccaccagtccaagagcagcagctcctcccggtagcggccccgcagttcctggctcacgctggacgagggcaggcgctccaccagcgggcggagcagtttcctggccttgatggccctgctgccgggaatctcccagccgtaaatcatgtccactatcagcagccggtattggtcaagaatccgctcgtgctgctcttgcttgccgtagagctcgcccaggtaacccgggtgcatcaggtcgatcatcaggctacagaggaagagcagcccctcctgctggtcggtgagcacctcgacgatgggctctacgagattacggtactggattaagtcttcgatccggtagaagtccgcgtagcctagcaggtcggtccaggccttgcaggcggccgcgcggctctcgtcgtcgaggatgcgcgcgccgaatttccaagtcttacgcaggcagtagtcgaattccgtatccatgctgtggagcacttggaccacatggtcggccagctcgcgctcgtcgtcctctcccacgaattcgcccagattgtatgttttcgagccgaaaatctgcgcttgagtgcataccaggtggccgttcgactccctgacccgcaccaggtggtcggggttggccttgctgtacaccgtggggccgaattcgcacaggtactcggggtgggtctgcttaaagaccctgacgaactcagctatagaagccatctcatcccctccattccgcccctgcacgagcgaatccgcgtcagccttgccctaggcgtccgtgctctataggctagccgcccctccttccattcgcggatcgcgccaggctggtcatccgcaggaccggtgatgcgtctgcgggcttattggcgcaccgagcgcgtccttggaatccttctccgcgttcgctcaagggcatttcctcgccagggctcaggcttcagcatccctcttcacgaagcgtcggcagaacttcagcaggaggcggattgcctcatgctgagcctcgctggaggatgggctggtgatcagataggcgggaaccgtcaggggcgggtcaatcggtgccgaccatatcccctggtagtcgtgctgggactcgtaatcctcgtaaatcggcacccaggcaggcttgtcgtagatggacatctgcacgaaggcggcttcgaccgtgctgaaggtgaaagcgcgcggtaagagtttcggctcgatttggaaggcgtgcgcgaccaggtccaccagcatggggttctcctggcgggtggtcagggccatgggagtatggcgcagagactccaggggtatgcgggaagctccgaatgactcatgcgccctgttcacggccgccactaggtaatcctcgcaaatcagctcggagttgctcatggctccggccctgcgaccacgcagaatcgccgcgttcacctggccgctttccagcagggagaccctttgggcgggtttggcttccactatctccagttgcacctttttggcccggagggcgttggcgaccttggtgacgcgctccgtcatgcccttgccgatggtcagggagatggtgatgaggccgctggattcccctgggagctcacctcccggcgcagccgacccacgtcacgcatgacgaccgaggcgaggtcgacggcggtcctcccttcggaggtaaggcgcaccgcacggtgggacctgtcgaagagcttcactcccagctcgcgttcaagtctgccgatttgctcgctgaccaccgattgcggcaggaaaagggcctcggcggccctgctgaaattctcttcccgggcggccgtgaggaaaatttccaactgcctgatttccaagtgctccccgccccctcaacacgaatgaacagctatcgtattctacgatagttcccttcgcgctttggcccttgctgccagtatcggtctgagaaatgattgactccgtaaaccgggaaaccggaaaatgcaatgattaggaaatcaaatgtcgaacatggtaattctcggatcaggcaacgtcggcaccgccattggcaagggcctgcgggacgctggccatgcggtcgcctcagtcaatacctccaccagcgtcgaggatgtcgtgcaggctattcgacaggcggacttcgtcttcctcgccgttcccttggcggccgccctgtccctgcagcaagcctgggtcgacgccctggacggcaagacggtcgtcgacatgaccaacccccttacccccgacttcgcgaacctcaccgttgggttcggcgattccgccggcgagcaggtcgccagggccctgccgaaggcgaaggtcgtcaaggcgctcaacgctgtgctggcccccaaccatgacctgaccgctttcggcaaggaccagatgttcgtcccggtcgccggggaggaggccagcgccggtacggtcgtggacctgctccgctcagtcgggttcgacgcccaatacgtcggcgacatcacctgctcccgctacatcgagcccgtggccgaggtgctgattcgcctggcgtacatgcagggccagggcactggcatcgctctgaaactcatgcgcgcgtaaccccttcttgttggaatccctgcgtaggcgagacgggtcgcctgactgccggcgcggccctcgacgggcttaagcggtcgagggccgcgccgcgcgtcggctgcccgggcggcccgacgccaaggggagggattgaagggggcccgcaacgtccccttcgcaagccgcgttgcagctacgcgtggcccacgcgaatgggcagtgcatagctgcaacgcgttgcttgcgtataacgcccggatgggcgatcgtcttatcccaggcggcctacgcgcctgggtcctccgttcatgcggactcgactatcagtcacacaatcgcccgctggaatcacacgattccagcgggcgattgtgattatcgaccgtctacgtgaacgatatgaatcaatcagaagcaacgagcgaagcaattaccatggctatcaatcgcgggaccagtagctccgttatttatatcatcccaaattccgccactatgacttggtgctgccggtgctggcgctggcgcggatggcgccggcgctgatggtgcgggcgtccaggttgaacgcgaaccaccgccattggatcggtatccaccgccattaccggagtggtacccattacctccaccccagctgcgcgttcccgtataaccaccgcctgaatagccctgtcctgatgacggcgcggcctgcgcttgtaccgaattcgcggccgatgccgtagcttgcgcgtcggctgcggcctggtcggcttggtctttggctgttttggagtcgttgacggctttggtttggtcgttgatggcttggatggccttgcgttggtcgtccacgctggctttggcgttggcttgcacggccttggcttggtcgagggcggtcttcaatgcgtccctggtggcgttgtcggcgacctgcccgtcggtggagcccaggagctggtcgccgtcgccgatggccttgtccaaatgggctttgacggtcttcctcacgtcagcggtcaaagcggcgttcgccgtggcgatggccttgccgtccttgcccgcctggtcggcggcttggcggatggtcgccgtgttgccgttcagggttccggcgttggcgtcggcggggcaggaggggatggcccgcttgctgtccttgaccggcttcgccttatccttgcccttgctggcttcgtcccccatggcgttggtgacggcttggatgaccttggcgtccgacacgtccccggccggggtggccttgacctgctggctggcggcggatctcgtcttatccagctgcttgacggcgctctggtactgactgctggcgttctcgcaggcggacagggcccttgaacgggtcgcctgccggtaggccaacacgcccgcgacgacgagcgccacgacggcgacgaccgcgacgatgatccaaagcctgcgacgcttgtggctggcctcgggcatagtttcgtctgtagttgcatccatgattggttccccttaacttctccaacaatgatgctctcagcataacacagtgggatgaataccactttatagagcgaggaaagcccgttggaatgggcgtatgaaggataaatcccactacctagattcgcttggtggtgtccccgacctggtggccacctcactggccgccgtgcctgatgtggcctcccaggccccggggctgattcctcccccgctcctggactgggagaattggcgcgcgatggtccgagacctgaaagccgagcggggcgtctccatcaacgcgatcgccgaacgttcgggcctggaccgctccaccgtcatcgagctcctgaacggccgtcggcaggtcaagagctttcgcgtggacaccctgtggtccctggcctgggctttgggagtcactccgaaggaattccccgccttcatcagtcccctggtcgtcccttacgacggcggtggaaggggggacccggatgaagcgcggccggctgtataaggagggggcggtaccactcctgcgccttactgatttgcgcgcgccgccgcgtaagggtccctattgaacacgccttgatgaacagtgctcgggaccggaaaagcgaaagctcggaatcatagagattccgagcttaatggtagcggggtcaggatttgaacctgagacctctgggttatgagcccagcgagctaccgagctgctccaccccgcgtcggctgccttgcgcagctctatctactatagtgactcgattgcgattgtcaagtttcggtatgggtgaaacgccgggcgaagggcgtagtgccaaggcttctcggccctcatttaccttgcgcggctaaaaggggtaatttgttgcgggtagttatgtggtttggcatttgcgtttaaatgcgcctagactgaggaagattaggctctagtcgggtcaaaacgcggtcaatagacggtgaatggcgatgtcgggcgctatagtaagcgcagattgccatttcaggaggcgatagatggtagaagcagtagggagcggcccgcttatactggcggcttcgaagccggagcttcccggtatcgacgacttcatgccgcccgaaatcctcttccaaggcactccgttcgcgatgaaccgcattattttcgtccgcttcatcgctatggtcgtcatcctcctggttttgggcatcaccgccgctagggccaagctgattccctcgcgctggcagggcgcggtcgaatggctgatcgagttcgtgcgcgattccatcgtctacgaggtgatgggcgagctgcgcggccgccgctacgtgccgatgattacgaccatcttcctgacggtcatgtgcttcaacctgtgcggcatcatccctggcttgaacatcgcagccacggctacgatcaccatgcctctggtattcgccgtctggacgctgatccagtacatagtggcaggcgtgcgctcccagggcctgggcaagtacctcaagcaggagctgttccctgcgggtgtgccctggccgatttacatcctgctcacgcccatccagctgctggagatgctggtcatcaagccggcctccctcaccattcgactcttcgccaacatgatcgccggccacttgctggtggcgatcagcctggcgttcgcccagttctacatcatcgtggccagcaacaagctgctcgtcctggcgggcgcgggctggttcgccttgggcttcgcgctcaccgctttcgagattttcgtggcggccctccaggcatacgtcttcgccattctgtcgacggtctacatcaatcagagctaccccgaggtggactgatatgaatgggatggaaggcgcaaggacgggacggaccttgaatcgcggcgcgtctacggacgcccgcgcctagggatcgctttcgccactgtaaacccacaaccggcgacggtttaggaaaggaacataaatatggacatcatcactctcgctgaggtcactggcagcgtcagcatcatcggctacggcctcgcggccatcggccccggcctgggtctgggcatcgtggtcggcaagaccctggagagcatggctcgccagcccgagatgagcggcaagctccagaccgtcatgttcatcggtctggccctgatcgaggtgctcggcttgctgggcttcgtggcgatcttcatcgcctagcgagctggcccgcagagggtaggcaagcaaagcagtgcaaggcaagactaaagaaaggagacgcagatggagccgatagcggccaacgggggtgtaagcctgttcatccccaagacttatgacattttctggtcactggtcatcctcatcatcctggcggtcttcttctacaagtacttcatgcccaagttccaggccatcttcgacgaccgcgccgcgcagatccaaggcggcatcgagaaggcgaagaaggctcaggaagcagcggaccaagcgaagaagagctacgaggaccagctgaaccaggcccgcgtggaggcttccaagatccgtgacgacgccagggccgaggcctcccacatcgtggccgacgcccgcacccgggccgagagcgaggccgagcagattaccgccaacgccgagcgctcgattcagtcccagcagcagcaggccctggtctccctgaagggcgaggtgggcacgttggccaccgccctcgcaggcaagatcctgggctcccagctccaagactccgccgtgcagtcctcgatgatcgactcgatcatcgccgacgctggcgggcgggattcggacttgacgaaggcatgatgactggcagaaagacccagcggctggccgagcgccagcggcggacgaggaggaggtgacatgcgaggagaagcttcgctcgtctccgatcaggaggcgaggaccaagttcgcgcccctcctggagggactaggcgcaggcgcgttcgacgtggccgaggagctcttcggtttcgtgaacctgctcgacgccgatccgcgcctggaacgcgccctgacagacccttcgcggccagctcaggacaaggtccgcgtggtggacgagctcctcaagggaagggctcaggacgctacggtggagatcctacgcgacctgtcgggccgccgttggagcaagctggcccacatcgccaatgcggccgaggatctggccgtggacgccgtggcctgctacacggccgtcaaaggcgagaccgcgcaagtggccggcgagctggctcagattcactcagccctgatcgacctgccgatcgtgctcttccgcctgtccgacgagtacagcgattccaaggcgcgcgtcgccctgttggatgaactgctggctggcaagaacctgcaccaggtgaccattcagctgagcgaacacgccacgcgtgacctgagaggccgccgcttcctcgagacgctcaactggctgatcgaccgtttctcttcgcatatgaaggagacgatggtcaccgtggtcactgcggtcccgctgagccaggagcagagcgataaggtggccgaggtgtacgccaggaaactgggcaggaacatccacatcaatgcggtcgtggaccctgcggtcctgggcggcatgcgtgtggagtacggctcggaggtgaccgaccatacggtcgccgcccagctcaaggggctcaagcgccagatggctgtggccgggtaagcgaccggaggtatgacagacttgaacagatacgacaaaaggagtgatcatggcagaattgaccattgatcccgccgtggtgcgcaaggcgcttgacgatttcgttgagtcctaccagccctcggacacgcccacccaggaggttgggcatgtacggacggctggcgatggcatcgcgcacgtggaagggctgcctggttgcatggccaacgagctgctgacctttgaggacggcacgctcggcttggcgttcaacctcgacgcccgcgagatcggcgtggtgattctcggcgacttcgcaggcatcgaagagggccaggaagtccgccggaccggggaagtgctttcggtgccagtcggcgacggctacttgggccgcacagtgaaccctctggggcagccgattgacgggctgggcgagatcaagaccgagggcaggcgcatcctggaggctcaggcccccgacgtcatgcaccgccacccggtggatgagcccctggccaccggcctgaaggccatcgacgccatgactccaatcgggcgcggacagcgtcagctgatcatcggcgaccgccagaccggcaagaccgccatcgcgctggatacaatcatcaaccagaaggccaactgggattccggcgaccccaagaaacaggtgcgctgcatctacgtggccatcggccagaagggcacgacgatcgcttcggtgcgctcctccctggaggaggccggcgccatggagtacacgacgatcgtggcctccccggcttctgactccgccggcttcaagtacatcgcaccctacactgggtcggccatcggccagcactggatgtacaacggcaagcacgtgctcatcgtcttcgacgatttgagcaagcaggccgaagcctaccgttcaatctccctgctgctgcgtcgcccgccggggcgcgaggcctaccctggcgacgtgttctacctgcactcccggctgctggagcgctgcgccaagctctccgacgacctgggcggcggttcgatgaccggcctgccgatcatcgagactaaggcgaacgacgtctcggcctacattccgaccaacgtgatttcgattaccgacggtcagatcttcttgcagtccgacctcttcaacgccaatcagcgccccgcagtggacgtcggcatctcggtctcccgcgtcggtggcgcggctcagaccaaggccctgaagaaggtctccggcaccctgaagatttcgctggcccagtatcgctcgcttcagtccttcgccatgttcgcctccgatttggacgcggcgtcgaaggcgcagctgacccgtggcgcccgcctgaccgagcttttgaagcagcctcagttctccccctatccgatggagaaccaggtcgtttcggtctggattggcacccacggcaagctggatgagctggacctggaggatgtgctgcccttcgagcacggcctgctggactacctggaccacaacaccgacatcctgaagaccattcgcgagaccggcgacttcaccgacgacatggagaaggccctggatcaggccaccgatgagttcgccaagaccttcgtcacgcatgatggcaagaccctgggcggcgaggcgtctagcgagtcccaggaggtcaaggtggagcaggagaagctgcaggtccaggagagcaaagcgggggagcggtagaacatggtctctcagctcgcattcaagtccaggatcgcctccacatcgtcgctggagaagattttcaacgcccaggagatgatcgcgtcttcgcacatcgccaaggcccgtaaggtggccctggatgcgaagccgtactctgatgcgattttcgacgcggtgcaggctttggtggcccacaacgatgacatccgacacccgatcatcaagaagaacgagaagaacccccgcgtggcggtgctcgcgctgacggccgatcgcggcatggcgggggcttacacgtcctcgatcatccgcgagacggagaacctgctcagcaagctggataagtccggtcggcagcccgagctcttcgtctacggccgccgcggggtctcctattacaagtaccgcaatcgccagatcgcgaagacttgggagggggacaccgacaagcccggggttcggatcgcggaggagatttcctccacgctgatggacgcttatatggcgacggcggaccagggtggggtctcggagctctacatcgtgttcaccgagttcgtcaacatggtggttcaacgggtgcgggtcctgcggatgctgccccttgagctcgtccaagccagcgatgcctccagcgccgtcgacgcgccccttccgggcgaagacaagcacgagatgaccgccctctaccacttcgagccctcggccgaaaaggtcctggactcggtgctgcccaagtacatacagggacgcatccacgagtgtctgctgacagccgcggcctcggagaccgccagccggcagaacgccatgcacacggcgacggacaacgcgcgcggcctgatcgacgacttgacccgcaagctcaacgcctcacgccaggcctcgatcacccaggaacttaccgaaatcatcggttccgccgatgctttgaataaagaggaagagtaggaacgccaatggttgcacagcaagagcagaccacagcggcccaggaccctgcgctcgacaaggccactgaaggccgggtcacccgcgtgcagggctcggtcatcgatgtggagttcccggcgggccatctgccggacatctacaacgccctgaccgtggacttgagccagtcctcggacaccgagggcgagtccctgaagacgatcatgcttgaggtggagcagcacctgggcgattcgaccgtgcgtacggtggccctgaagcccaccgacggcctggtgcgcggcgccaaggtcaccgataccggcggccccatcgaggtgccggtcggcgacgtgaccaagggccacgtgttcgacgtggcgggcaacatcctcaacaaaaaagagggtgagaccatcacggtcaaggagcgctggcccatccaccgcaatcctccggccttcgacgagctggagtccaagacccagatgttcgagactggcatcaaggtcatcgacctgctgaccccctacgtggagggtggcaaaatcggcctgttcggcggcgctggcgtcggcaagaccgtgctgattcaggagatgatccagcgcgtggcgcagaaccacggcggtgtctccgtgttcgctggagtcggtgagcgcacccgtgagggcaacgacctgatcggcgagatggaggaggctggcgtcttggagaagaccgcgctggtcttcggccagatggatgagcccccggggacccgtctgcgcgtgccgctgaccgctctgaccatgtccgagtacttccgcgacgtgcagaaccaggacgtgttgctcttcatcgacaacatcttccgcttcacccaggccggctccgaggtctcgaccctgctgggccgtatgccttccgccgtgggttaccagcccaacctggccgacgagatgggcgccctacaggagcgcatcacctccacccgaggccactcgatcacgtccctgcaggccatttacgtgcccgccgacgactacaccgaccccgccccggccacgaccttcgcccacttggatgcgacgaccgagctttcgcgcgacatcgcctccaagggcatctacccagccgtggacccgttggcctccacctcgcgaatccttgatccgcgttacgtgggccaggctcactacgactgcgccaaccgcgtcaaggccattttgcagcgcaacaaggagctccaggacatcatcgccctgatcggcatcgacgagctgggcgaggaggacaagaccaccgtcaaccgcgcccgcaagatcgagcagttcctgggccagaacttctacgtggcggagaagttcaccggccgtaagggttcctatgtgccggcctccgagaccatcgaggccttcacccgcatctgcgacggcgcctatgacgatgtgcccgagcaggccttctccggcatcggcggtctggaggacctggagcgcaactggcacgagatgcagaaggaatacaagtaatcatggctgcttcctccaagggcaccatcgtggtgaacgtcgtggcctccgataggcccgtctggtctgggcgggcccggtcggtcacgattccggccaccgagggcgcgatgggcatcctacccgaccatgagccggtcctggtcctcaccaagaagggcacgctgaccgtggtccaggaggacggtcagcgcaccgacttcccagtcagcgccggcttcgtctccttcgattccaacaagctcaccgtcgcggtggaccgctgcgacgatgagtcccagtccgcttgagtgagcgctgagtgcgcgtcatcgtagcggattgctcagctgagtactcggggcggctcacggcgagcctgccccgggccaagcgggtcctgctggttaaagcggatttctcatgtttgattttctccgagctcggctcctataagccgctcaattggatgtgcgcgccctgcacgctcaaagaggttcgcccgcaagacgagcaggccgccgcaccaggcgaagacgacccagtccagcccgacgacctgcctgtaggccaggaggaagcgccgggcgttgagcgcatattgcgcgtgtgcgcaagcaagtccagtgacgtgctgacaatcagcatctaccacacttacagcgaccaggatttcgacctggggaaggacccgggcctggtcaaggacggggtggaggaccatctccagcgctacctggcccagcagatcgagcggattggcgaaggtgccaggttggtgcgccgcgagtatcccacgcccatcggcccggtcgacatcatggccacggacggccaggggatgcatgtggccatcgagatcaagcgccacggaggcatcgacggggtcgaacagttgaccaggtacgtcaagctcctgaacagggaccccttgttggccccggtgcgtggcatcttcgccgctcagaccatcacccctcaagcgcgtgtgctggccgaggacaggggcttcgaatgcctgatcctcgactacgaggagatgaagggcgccgaaagcggcgagatcaccctcttctgactgcctggggccccctttcgtggtcggggtggttgggcgtcgagcccgtcaaatgtgacttatatggcagtattgctctcagctctcgtgagccttacgtatccgctggaagctactaaatatagggtttccaggtaagacacgcctctatgtattgtggtttgctggcccggggtcccttgactagagtacacaggaggcccggttgaacgggcggcggacgcagagcgaatacgcaggttattttttagagaggacatcatgtcagtcacggtctacaccaaagcccattgcccccagtgcgacgcgaccaagcgccagctggccaagcggggcgtggccttcgacgcggttgacctgacctcccagcccgagctggtcgagtccttcatggcccggggattcaaacagactccgatcgtcgtcagcgaccaggggacttggagcggctaccggcccgacatgattaagcagctggccgagcagtcggccaaggtcgaggcctgagtcgaattccgggcgggctcttgcagcctggtccagggcggcggtacgtgaaagaggcggggcgacgaaccggtgttcgctgccccgcctctcgtgatgcccgggcctggagggccgggccagggactgggtacgtcagtaagcggccaggatgtccacgacgaaaatcagcgtggaattggcagggatgcccttctgggccttgtcgccgtagcccaggttcggcggcacgaccaggagcgtctgggagccgaccgtctgcccggccaggccttgcttccagcccttgaccacttggtccaggctgaaatcggccggttcgccccggtcccaggaggagtcgaactgcttgccgttggaagccaaccagccggtgtagtgggctgtgaccgactgcgtgtctttgacgaccggtccggtccccttgatcagggtctgtgagaccagtttgcctgagggctgataaccgttcaggttcaagctgggcttgccgctggagtccagggaaatcttgggcaggtcggcgggtatgtccttgacggcttcgcccttagcgcgggtcagcggcttgaacttggagacgatcgtcagggccatcacgtacttgttgtcgccggtggactggcccgaagcgtcgttaatgcccacggccagggtgccgttgaccttcatcgccttgaaggcgtcatagtactgcgggtaggatttgcggttcaccgagatttggcagtcgggcgaacccttctcccaggtggagtccagctccttgccgtccttggcgctgaccgccactgagcgcacgcacaggtggtcgccgtcctgcatggcttcaccatcgccctcctggacgatttgccaggatttgtcggtcacctccaagggggttttgaaggagatcttgggtttctggcccagtttgccgtcagcggagaccccttcgagtttgccgccagctgaggcggatgaggatgaccccccgctggagggtgccggattactggatccgcaggcggtcaagcccaggcccaaggccagggcgcagcagcaggcggccattttgaccgctgaacgaagcttgtgtatgttcatagaaacccagcctatcctcccaggctgattttcgcgtcaaggcctcttgcccgccgtcccctgtagaatggggcatgttatgagcatatcaacgagcgaagagccaggcgaggcggtcaagcgcgccaccaccaagagggccaagatcatgcgcggcgttgtcacgcctatcttcgggctgcttgccgtggcctgtttcgtcttcggggccttgaacgcgacgatctggaagccaaaccaacaagtggacgcttcgaccgaggtcgattccgcatacgtggtgaccgatccgggcgtgctccagctggtggacgaccaggtgagcgtgaccgcgtccctgggtgacgggcgcaagcctggcatccaggtctgcatggccatagggtcggtccaagacgcgaccggctggatggccggtcagtcgtacacgcgcgtcaagggcttggatagctggaccaagctggagaccgacggcgcgcgggcgccgggcaagcaagccaaagacgacgggcaagtggacttccagcattcggatatgtggcagcaagtcaagtgcggcggcgcggcggtcaccatgacggccgatgcccaaccagggcaggtggcgatcattagcgtggaagcggaccgggggagcaagcaagcgcaggagaaggcggaccagagcgtccgcccgcgcgtggatgtgaagatgcactggggccggaacaagctgcctaacttctccctgcccttctacatcgcaggcgggctgctgacccttctcgcggtcctgtccgcgtcggtcttagcgatggaccccgccaagctccgcaagggcaagggaggcaaggaggagcccgaagtcaccgtagctcaagcgttcggcggtgttttggcccccttggcatcggtcttcaagcggcgtaagcccggctccaagcgtcactcacgacctgagggcgggcaagaggaccggacgggtcaacagcccaagatcgtggatgtggcctccaagaatatggtggccgatcaccaggcaaacccggacggcggcgaatccggcgccgaggctgatgaagcccctgctggcggcagcgaccaggcgcaggggcaatccgctccgaccggtggagctggtggcgaggattccctacaggcctacttgagccgtctggctgacgaggtatccagcgacgggtctacggacgcgggcgatgcgcaagacaccgctgccaaagccgaccctggcgacggggctcaggctgaaggcgcagccgatgcgcagcccgaagtgagcgagggcgaagacggggctgaggtctcggacgaaacccgtcaggccggtccgtcgcgcgcttccgccgaaattgacgacaccacggtgggcgcctcgccgtcctccggacccgcaaaaatcgccgggaagggcgaggacatcgatgaccgcaccaatccaggccaggaaagcggcatcagcgatgagaccacggaagtggaccaaggcgatatccgcagccgcacccgggcccaacgattgaaggcgcggggcgccaagagcagccctgggccccaggaacggaaggggggatcacaatgattcgacccagccgtaagcagtgggcgagcaaggccctggctgccgtcctgtcaggcgcggccctggttgggttgaccgcttgcgagggccaagtgcccaagcccagcgctcaggacaccgccagctcatctgccacgcccatgcccgacttgaccaccgagcaagaggccaagattcgtggcaccatcatcgagacgctgaacaaggcgaacgaggccaaggaccccacaggcttggacgcgcgcgtgaccggcccccaactggagattcgctcctccgagctttcaatcgccaaggccacgggcaagctcgaccccaagaccacgatcccaagcaagatcgcccagaccgtgatccccggcgacacaggctggccccggtcggtgttcgccatcaccactacgaccgaggaccagcagtccaagcggctcctggtcatggaccagcagtccgcccggcagaactacaagctctggggggtggcccgcctcttccagggggcgcaactgcccaagttcccggtgcctacgatcggcgcccagatgggagccgcggacgacaagagcctcaagcagacgcccgcccaggccgtcgaccactacgccgacctgcttcagcatggcaaggacagcaagcacgctcaggagttctcctccgattacttgcgcgagtcgatcgacaagctgacgcagaccgtccagcaaggcatcgatgcgaacaagggcgagcaggagcaggtcttccaacccgtgcaagggcagatcagggtcatgcgctcctcggacgggggcgacctggttgtggcgcagattgattcggtttggacgcgcaaggccggcgaggggcgcgaatccctgcccgcctcggacgcggagaaggcgcttttcggtggaggcaaagccacgagcacgatgaaagtgacctacgtgaacgtagtcgccctctacgtgccgccctcctcgtcttcggagccgattaaggcggtgggcgccgagcgccagccgattaaagtggaggccatctagctcccacgagccgctaagccgctggggaagagggcgcggcttgggcgggcgcagggctaggtttggaaatatacgtatccttcaagcataaggagatggtcgcatggctcagcatgatcagcctcagccgggattgtcgctagcgggcgcagtggacctggggtctttgaagcaccaggtggatgcccagcccgggcaggctggaggcgctccagcggccggcgggtatgtgattgacgtgaccgaggcctcattcccggctatggtgcagacatccgcgacctaccccatccttctcctgctctggctgcccaccgacgaccggctcttccctatggctcgggccttggcggacgcggtcaacggccaggggggcaagcttcagctggcccgcgtcgacgtctccgcccaggcgcagatcgcccaagcccttcaagccaagggcgctccagccctttacgccctgctggccggccgccccatgccgattttggaaggcctgccgtcggccgaggagttgcagcagatcaccgaccagctgattccacagattatccagctggcccagcagcaggggatcactggttccgccccctaccaagagggtggcgatagcgatggccaggaggggcaggagcccacagcgccgactgtgcccccggcccaccaggaggcccaccgtatggcccaggaaggcgactatgcgggcgctgcccgggcttacgccaaggtcttggagggcgatcccggcgatcagctggctgcgcgagaacgggccaaggccctgctgatggatcgctcggcccaggtggacgtgcgcgaggcccgtcaggcggccgcggaccggccggacgatgcggatgcccagatggccgctgccgacgtggacatgattggtggcaaggtggaggacgctatggggcggctgatcgacttcatcgccacccacaaggcgcagatgaccccggtccacgaccggctcctggagtacttctcgatactcgaaccctcggatccacgcctggctgcgtcccggcgccgcctggccacatccatgtactgagtcttgggcctgagcctggggcaaggaccgaacgtaagcccggacctgtttccctaatcgccgaccgcttggttagtccaagcttcggttggagccgaagttctccaggaagtgggagccgttctcctggagctcctgctcgaaggcggaggcccaggtgcggtagggccgttcggctaggccgtcgttggagaagcgcgggtcatcggtgatttcggtgatgcagaagggcggaatcacgaggtcggtcaccggcccggagcgctcgacctcggccacggccaggggggcgttgcccccgccgaagatgtccacgttccaccagtcctcgttcagccagaccccgtagcggttcttgacgatcagcgagcccccgcgcaccaccagctccgccgctatgctcgggtcgagcgggcgctcggcctcgtagcgggtgccgcccacggccggccccttgacggtcatcgaggcggcggcgaagtggtcgcgctcctccaacagcacattcagggcatcggtgcgggcgtccatgcgccggcgcacgccctcggcctggaggcgcacccgcagggcgtaattgtcctcgtgcacgaagtaggactgcacgatcagcgtgggcgcgtcgccgtcatccaggtcctccggcagttggcggcagaagaaccggcgctcgaactcaaaatcgtccctgtcttcatccatgcgaccattctaccgggcggcggcgcgcgacgggtgcgaatggccgtgggatgggctagaatagcgaacgtcgttcctggcgccagcgcgtcagggcagcgacttgggctcgtagctcagcggatagagcgtctgcctccggagcagaaggtcgagggttcgaatcccttcgagcccaccagtagcaacccccctgcgattcctagaaggttgcaggagtttgctgtgtgtggttggatgcggcggaagcacccggacagaagtgaccgattttatttaattttgtcagctacaataagccctgatggctgattttccaacgattttctatttaagttagataggtacgggcatatggcagtttcagatgaagatgaactccgccaatatcttacgggcgatgaatctcgacatcttgagttgaaagaggctgcccaccaatacaataacgacaagttgatgcagtactgctgcgctatcagttgcgagtcgggctgtctagccgtaagaccgcacttgtttctcagttgatacgtgagactgtagaagctgggttgatatttctggatccaacggcaaaatcgaggaaagcggcacggtacctgccgttctatcttgctgagtcgagtgataacgattcgcgtgtaaattaatgagaattggccgtgtggtagatgttttgcatttaagccgatgaactacgggaagccggaatcggctattttccaacggaattgtattttaacgatggccgtcggccggctatgttgcataaagtgcaccggcgtactgaaacacatgaggtaagaatgacttccctggtatatggcggggccggtcagtgctttcgctagacttgggggcatgagccctgaagaacttgctattgagattaatgctgtgtgccggagtttggctgagcagaccgcgcttggcgccttgggagccgaggatataccggaggtcgggaagctcgcggtcatgcggcctaaggaccgggcgcacggcgactggtccaccaatgtggccatgcaactggccaagaaggccggcatgaacccgcgcgatttggcgcagtcggttgccaacgagctggtcaacgggcacggcatcgcctccgtcgaggtggcagggcccggcttcatcaacatcacgctggacgcggcggcttcggcggccgtggtggacacggtgctggaggctggtgaggcctacggttccaacgggcacctggcgggcaagacgctcaacctggagttcgtctcggccaacccgaccgggcccatccacatcggcggcacccgctgggcggccgtgggagactccctggcgcgcgtgctcaaagccaacggcgcgcaggtggtgagcgagtactacttcaacgaccacggcgagcagatcaaccgcttcgccaagtccctggtggcggcggcccacggcgagcccgcgcccgccgacggatacaagggcgcctacatcgacgaaatcgcccagcgggtgattgagcaggcccaggcggacggcgttgacatcctgaacctggggcgcgtggacgccggcgcgaacagtgagggcgaaccgttgggcgagggcgattcgccccagcgcgaggagttccgcaagcgggccgtgccgatgatgttcgccgaaatccagcagtccatgaaggatttccgcgtgaatttcgacgtgtggttccacgagaacagcctgtacgaggacggcgaagtggagcgggccttcgacgttttgcgctccaagggcgacatctacgagcaggacggcgccacctggttcgcctccaccaagcacggcgacgacaaagaccgcgtgatcatcaagtcggacggcaactacgcctacttcgccgccgacatcgcctactactacaacaagcgccacaggcaggtgagcccggccgacgtggccatctacatgctgggcgccgaccaccacggctacatcggccgcatgatggccatgtgcgcggcctttggcgacgagcccggcgtgaacatgcagattctgatagggcagatggtcaatgtgatcaaggacggcaaggccgtgcgcatgtccaagcgcgccggcaacgtcgtcaccatcgacgacctggtggaggccgtgggtgtggacgccgcccgctactccctggcccgcaccgactacaaccagtcggtggacatcgacctggacctcctggcctcgcacaccaacgaaaacccggtctactacgtgcagtacgcccacgcccgctccaagaacgtggaccgcaacgccgcagccgccagcattgacacgacgctcgccgacctgagcctgctcgactccgaagccgacgaggccgtgctggcccagctggccatgtacccgtccgtggtgcagaccgccgccgaccagcgggccccccaccgcatcgcccactatttggaggacttggcgggcgcctaccaccgctggtacaacctggagcgtgtggttcccatgccgctgaccgacccggagaaccgggagggcggggagcgcgccgccgagttggaaaaggccaagaacccggagcccgcccgcgccgccgcgcgtttgaagctcaacgacgcggtccagcgggtcatcgctaacggcctgggcttgctgggcgtatccgctcccgaaaagatgtgaacccgcgcgcaggcaagtcgcctgccggaaggataagcagcatgaccatacccgtgattctcgcctcccagtcgccctcccgccgtgatttgctccttcgcgcaggcatccggcccaccattcgggtgtcgcaggtggacgaatccgcggcccttaaaaccgcggccagcgagcgaggcgtcagcctgcacttcctgcccgcccgggaacgggtcaccatcctggccggcgccaaagccggtgccgtgcaggagcgtttgcaggccgtgattgaaaccgaatcccgggcccggggcgagcagttgctctcgcgcccgctcgatgagggctacggctccatccactcccgccagcccatgcagcaggcggtggccgctgggcaaggcatgttgaacgcggcagcgggccctctgatcatcggctgcgattccctgttcgagttccaaggcgaggccttgggcaagccgcacacccccgagcgcgccctggagcggctcaaggccatgcgtggcgagaccgggaccctgtggaccagtcactgcctgattgacctggcctccgggcgccgggtccaggccagctccgaggcccaggtgaccttcggggactacaccgacgccgatatggcggcttacgtggccaccggcgaacccttggaggtagccgggtccttcaccttggaaggcttgggttccgccttcatcgcgtccatccaaggcgaccccagcggggtcatggggctcagcctgcctaccatgcgctcgctggtggagagcctaggatttaagtggtcggacttgtggaacgagcgcgaggacagggagcgccagcaggccgtgcacccggagacggcgaaggtgccggacggcaacattcaccagcctggagatggctgggtcgattgcgcttgcggccgcctgcactgggggctcaacggcgccgccggagtgctcctggcccggcgggacccgcagacgggcctggtcagccaggtcctcctccagcaccgcgccgcctggtcggccgagggcggcacctggggggtgcccggcggagccatcgccgacggggagagcccggtggagggcgccctacgcgagtcgcacgaggaggcgaacatccaccccgaggacatcgacgtaatcggttcctacgtggaggaccacggcccctgggcttataccacggtcttcgctacggagcgtgaaggccaccaggttgagccgcgcgtgaacgacgacgaaagcctggagttggcttgggtgtccctggaccaggtggccgaccgcgagctcctggaggccttcggccgcgactggcccgccttcatggagcgtttgcaagccttgccgccggttaggtaggcacatgcagcggaccgcctgacggggcgcgctgtcctgcgctgtgggtccggacccagggctctcaggagaggatggcggctatgagggctatcacgatgggcgaggagatggtggacaggaggatgccgtcgcgcgcgaagcccatgcccacctcgtagcgggccgcgtagttgtacacgttctggccggtcggcagggccgccaggaccacgcagccgtagagctcgaccccccggaagcccatgacgaagtaagacagaaggaaggcgaccagcggcatgaccaggttcttcaggaccactacggtgagcgtggctggtcggtcggtcttctccttcatgggcttgctgccgtgcagggacatgccgaacgccatcaggatcatgggcaccgccgaggcgccgatcatgtcgatgggcttgaacacgaattcgggcaggatgaaatgccctacgtggtcagacagggcggagatgacgatgccgcccaaggagccgatgaggaggggctgtttcaggggctgcttggcgattgatgtaagcgagacccgcccggaggtggtggcgtcgagcacaatcaggccgattggggtgaaaaccacctgctgcatgagcaggatcggcgccaccaggctggggttgcccaagatgtaggtggcgaccggcaggccgatgttgttggagttcaggtagagcgagttcagggcgccgattgtggtgctggccgcgtccatgcggaagaagagcgcgttgaggagcacgaagagcaggccgaccgtggctgctgagaggaaagccacgatgatgctcgggtggaagatgacgcccaggtgctccttggccatgatcgcgaacatcaggcagggcgaggagacgaagaaggagtacttgttgaggaccatctgtgctgtgggtccgcccactcggaagcgcgccgccacatagcccaccgcgatgaccacgccgatgatgaagaacccctccatcgcgctcaagagcccaggcatgaattccccctccacgacgattgcgactacacactttctaccatgtcccgcgtcctgtcgcctgcctgcgcccaggcgggcttgcgcgctaattgccgtggttgacggctaccggggttgccgctggctgggttaagggtggtcgggggatttcttcccatcccttgtcaaatgcaggaaagcgtcaagccgtggggttgactaccacgagcagggggaaggcgcgtcgctcgcgttcccccgctgagcggcgcgccttccatgattggttatttgctgctggtggttgtggtgggttggttggtgtggtggtgtttgcgggtgatgtggtggctggtgagggtgagggcggtgagggtggtgagggtgaggagggtggctcccgcgagttgttgggtgggggcgccgcctgctttgggcagggtgtagtagtgggtgtagtcgtaggtgagggtgtggttgggttgggtggcgccgtcgagggtccagtggatggtgacggtggcttgtccttcggggtgggttgggctggtggtgtcccaggtgtgggtggtggggttccaggtgggtgtgggggcgttggtgggctcgaaggtggtgccggtgatggtgatggcgcgtgtggttggggtgggggtgtgtcgttcggtggtggtggtgtcgccgagttggccgtagccgttggctccccagttgtaggcgtggccgtccctgttgagggcgaggctgtggtagccgccggcgctgatggcggtccaggtgtcggtgttgtcggcggccgggctggcgggcgtgggttgtcgttggtcggtggtgttgtcgtcgccgagttggccgttgttgtcggctccccagttgtaggcgtggccgtcgcggttgagggcgaggttgtggctgtcgccggcgctgatggttttccaggtggcggtgttgtcggcggcggggttgacgggcgcgggcgtgctgtgggggttcgggtcgttggcgccgtcgccgagttgcccgtgggtgttggctccccagctgtaggcgtggccgtccgcgcggagggcgaggttgtggtagccgccggcgctgatggttttccaggtggcggtgttgtcggtggccgggttgacgggggcgggcgtgttgcggtcgctgctgccgccgtcgccgagttggccgttgctgttggatccccagctgtagaggcggccgtcgctgctgatggcgaggctgtggtagccgccggcgctgacggcggtgaaccgcacgcccgggggcgtgctcacccgcacgggcgcgctgcggctggcgcgggtgccgtcgccgagctggccgttgaagttgtacccccaggcgtaggtgttgccgtcggtgccgatggccaggctgtggaagctgcccgcgctgatttgggtgaaccggaggggttggggcgggtcgggtggtgtgatgtggacggtggtgccgccggtgtccgggccccgggtgggggtcatggtgaaccgtggggtcctccatgtggcggtcagggtcaggtcgtttctgacgggttgggtgaagtcccaggggctgccgtcgggtttggcccacccgtcgaaccagtggcccgcccaaaccgggtcggggaccggccagttgatgggctgcgggtcgtccgggtacgagtactggctggcgggcggggttcccggcgccccgcccagttggaagctgacggtgtacggggtggcgtacgtgtaacgcagggtgaccgtgccggactggtatctggggttggcgatgttgccgttcacgtcgaggccgtcgagatggtaggcgacggtcacgtcgacggcgcccggggtgtgttggggcacgtgcatgtcccaggcgccggtggtggcgttgacggtcttactggtgacgcttgccccgccgaaggcgacgccgtcgatcacataccggggcgtgagcaccggcgcgggcttgctgtggtcgttggtggtgccgtcgcctagctgaccgaaccggttgtatccccatgcgtaggcgtggccgtccgagtcgagggccaggctgtgactgttgcctgcgctgatggttttccaggtgttcgtggggttgccactggagggcgtgctcaccggtgcgggcgtgtgttggttgccgccggtgccatggcccagctcgccttcgctgttatttccccatgcgtaagcgctgccgtatgtgtaggtgttgccgtctgagccgatggccaggctgtgccagtagcctgcgctgattcgggtgaagcgcacgccggctggcgtgctcacgcgcacgggcgtgctgcgtaggttgggggtgccgtcgcccagttcgccttcattgttgtaaccccatgcataggtgtagttgtccgatccgatggccatgctgtgcccccagcctgcgctgatttgggtgaaggtcacgccggctggcgcgtgcacgcgtacgggctggtttcgctgggttatggtggtgccgtcgcccagcttgccgtagtagttctgtccccaggcgtaggtgttgccgttcgagtcgagggccaggctgtgattgtcgcctgcgctgattcgggtgaagcgcacgttggttggtggggctggcggtgtcagcgtggccatggcgtcttggttggcggggcctttggtgggggacagggtgaagccgtccacggtttgcgaggtgggggctcctgatcgggtcaggtggttgggttcagcgtgggcgggccgggccgccgaattacccccccccccaggaggatcatggccagggccgcgaatgcggcgctggcggcgcggaaacgactcatcacccctccaaaacaggcccatatatgttgattgcgggttggaatgcggcggacctagctcctcaaccgatccgaacgcgtgaaaaccccttcactggactgggctcccagtgtagcagccaaaccacccgacaaaaacagttggcgggccagagaacgttacgagcggaccacaggcggggccagcttgccggtggtgagggggagcgcctgtccgttgcaagggctgagagaaggtggcgtagcgcaaggtgggcgaggggctcctccccaaaggcgaagagctcctccccaaaaaattgattactcgtgtccgctccgatggggccgtggtcagtgggtcgagcacgaaatcgtagcggcggatgagatggtcaaatcgttccaatccgcgtagggcgccgtccccgtatgagccgacttgtaggccagcgttggcaggagccgttgtgaagactccgcatacccctcctcccgtaaccgaagatgtgtcgcgttgaaaccaggtgacccctcgctttcgtccagcgacccgcccccggggataatattaaggaaaccgcggcgtctgagactgggaggtggggggcatgaggatcctgattcaaccggcgacgctgctggggattatcctggctggctacctcttcaaacgcttaaggctcttccgcgagcgcgactaccgagtcctccagaccgccgaattcaatctgatcctgcctggagccatcatctactcatttgccaccaacccccaccaggtgagcttcctgctgctgtccgccttcgccgtgctggccgcgctgctgccgccgctgggcgtctacctgaccacccggcgtacgcccgcggaccggcgcgccttcctgatgctcaacacctccggcttcaacatcggctgcttctgctttccgctcctgcaaacactgataggctcggcggccttggtgcccgctgccatgttcgacctgggcaacgacgtgatggtggcggcaggcacttcggtcatgacccaatcgctcctgcacatcgagcccggcaggccgctgtccgagcaaggggaggtggacgcgccggtcatgcccaggccgcgctcggacgacccggacgtccggcggctgcggcgcaaggccctgctggtcggcattggtaaggggttcttcggttcggtctgcttcgatgtgtacctgctgatggcgttgatgatgctgctgggtctgaacctgcctagctgggtggcgcaggtgacgcagcccttttccggggcgaacgcgctggtctccatgctgatggtggggatgctgatggaactgccggacggacgcggtgacatcaaagccgtggggcaggtgctggcctggcggctgcccttggggctgatcttcgccgtggccgcatggttcctgctgcctttcgacccggtggtgcgcgaggccatcgccctgtgctgcttgtctcccaccgccattttcgccaccatgttcaccgataaggtgctgggcaacgcccgcctggccggcttcaccctggccctcaccgctgtaatcagcaccgtcgctatggtcggcgcgcacctgttgaccgcggccctgtaagcgcccggctggcctgggggcggagggggcatgaaaaacgcccccgaccggggctctgcaaagccggccgggggcgagaattgtacagttcgcggggacccggggaatcagcggtactgcatgccgccgtctacgatgatggtctgaccagtcatgtaagcggacttatcgctggccaggaaggagatcacgccagccacgtcgtcggggtgctccaggcgctgcatggcgattgaatccaccatgcctttcaagttctcgcccttgggcttgccgttcagcttgcccatctcctcgtcgatttggccccacatgggtgtatcgaccacgccgggggcgtagccgttgacggtgatacccctgggcgctagctcctgggcggcggtctgggtcaggccgcgcaccgcgaactttgccccggagtaggcgccgagaatcgggaagccctcgaagccagcaatggaggaggcggagatgatgcggccgtgcttcttgcccagttcctcgaacttggccgcagccgcctggatgccgtagacgacgctgaagatgtcaacgcgcgccatagcctctagctgctcggtggtgatttcggtgaagggggtgacctggcagatgcccgcgttgttgaccatcacgtcgaagccgcccagctggtccgcggcatcgtcgaccaggccgaagacctcgtcgcgcttggacacgtcagtcgcccggaagaaggtcttgcgaccctccgcttcgatcgcggcgatcgtctcctgggcggtctgctcttgctgcttgaggtcggcgacggctacgtcgaacccgtccttggcaagctggatggcgatgctacggccgattcctcgggctgcgccggtcactacagctacttttggctctgacatccatgtctcttttctatccgcgccaatggcgcttcattcgcgccgcacaagcacgcgacgcacaagtcggaggactctgcgacgtcctccatccccttttcgtgactttatcatgccgcctgagggcgcgtcaatccgtatacggggcacggcgctggggagtcacattgtgagacgggaaaagcaaaaagcctggagctcgtgttattcttctgcatgtcggatcgccaaatcatgacattacataggagaactatgcacgagctgttcaggctcaaagagaatgataccacagtttctacagaggtggtagccggcatcaccaccttcttcgcgatggcgtacatcatcgcggtcaacccctcggtcctgtccacggcggggatgccctggggggccgtcttcatcgctacgatcatcgccgccatcatcggcaccctggtcatgggcctggtggcgaacgtgccctacggcgtggctccgggggtcgggctctgcgccttcttcaccttcaccgtggtcaaggggctgggcttcagctggcaggagaccctgtcgatggtcttcatctgcggcgtgctgaacataatcgtcaccgtcaccaagctgcgcaagatgattattcgcgcgattccgcccgtcctccaacacgcgatcggcggcggcattggcgtgttcatcgcttacgtaggcctgctcaacgttggcatcatcaagttcagccctgacaagtcctccgcggccggcgccaaccccagcctggccaccttcaacacgccctcggcgatcctattcgtcatcggtctggtgctgacgatcgtcctgatggtctgcaagttcaagggccgctgggcttttctcaacaaggcctctttcgtcatcgccatcatcgtggtcaccctgatcggcatccccatgggggtgacgaccgccgcccgctcggtcaacctcggtcaggcctcctcccagctgccgcagaccttcctggccatcttcactcccgccggattcccagccctcttctccgacccggccaaactgccgatcgtgttggtcaccatcttcgccttctccctgtccgacaccttcgacacaatcggcaccttcgtgggcaccggccgccgttcgggcatcttctccgaggcggacgagcggtccttggagtccggccatggcttctcctccaagatggacaaggccctgttcgcggacgccacggccacctcgatcggctccctcttcggcacctcgaacaccaccacttacgtggagtccgcatcgggcatagccgcaggcgggcgcacgggcctgacctcggtggtcatcgcggcctgcttcgccctgtccgccctgttcgctccgctcgtctccgcggtgccctcggcagcgaccgcccccgtcctggtcatcgtaggatgcatgatgatgtccacgttcggcgagattgactggaccgacctgtccgaggccatccccgccttcttctccgccatcttcatgggctactcctactcgatctcctacggtgtggccgctggcttcatcacctactgcctgaccatgacctgcaagggtaaggccaagcaagtccatccgatcatctggggcgtaggcgccctgttcatactggacttcgtcctccaagccatcttctaaagcagcgttggatgtacgcacgaacgcccacccgggcttcacttgggtgggcgttcactgtataagggccaggggaccgccggcgctcccggcgtgcggggcctgggcaccggtgtcgaagggatacaggccgccttttggcaggttgaaaccagaacctaggggaggggaggagcagggggcgcaccgggcgtcccggcatccggcaagcccaagggcgcagcggatggatacgtacgatctgcctgttcacccggcgaccgcttgcccctgcgcgggctccgtgattccccgattgctttcgcagccccccaccccttcccctggatgcgtggaaagctcgctgacatacgacgagggcccgtccgcgcgatgcggacgggccctcgtcatacggagtggtttagtaccagccggaggcttgggacttagcccaggcgccgcagggggtgccgtagcggctggcgatgtagcccagaccccagttgatctgcacgttggcgtcgctctcccagcctgggcccatcttcgagccaggcagggcctgggggatgccgtaagcgcccgaggggttagcggcgttcgtgcgccagccggactccttgttccacagctgcaccaggcaggtgaactctccctcgccccagccgcgggagaggaccagcccgtgcgccagcgcctgggaatcaccgaccggagctgtggtggaggacccagccgaagcgcttggggcgcttgccgagccgctgccggtgccgaccaggatgaccttatcgaccggggcctgcttgacgaaggaagcgaagatgttcgaggaaaggctcttgctgcctgccttggtgatcagggaggtcgtctccatgacgccgttctggccctcggtcttgaccttgcgggtgccagcgggcagggagtcggtcctctcctcgatcgtgttgaaggggatggcggagtcttcgctcttgaccgaagcgtcagcgcgctcgatctcgatggtcgtggactcgttcaccttcgtctgcaaggagggggtgacctggtcgccaggatccagtgtgatgtcgccggcgtccagcaccgacttgaccgtggtgaagtggtcgcccaggatgacccgcttgaccccgttgatcttcacgctcacgtaggaagtgccggagtcggaaccgccgctcccacggttgagagccttgcgcacattatcacgcgaaacctctgctgacccgttctcggtcgcggagaaggcggtcgcgccgggattgggtgcccggttctgggactggtggaaagtagtcgtggcgatgccgatgccaaccagcatgaccaccgcggagcaccccgcgatgacccgcatccactgacgtttggtcagcgctttcagccctgccgttcgcttcttgcgatgcgacgccattacgctccttcaactttgcttgcaaatcctcggcggccggtgcgcgctccaaacgcgaacccatccgcgtcagcccacgctcttgactacagggtcaacggaccaaaactccgccggtacacattctcgacgtattttagctcgcgcgcagtcatctgtacagctcggaggtcgaagggccggggcgcgttcacttcccggcgggctcctcggcgtcctcatcgagcttgacttcgcgggcctggcggatcacgtcgtccaggtcggaggcgcgcagggcgccagcctgcttgaagatgatctggccctgcttggcgatcatcagcgtggggaccgcctggatgtccgcagcggccgccagatcctggttctggtcgatgtcgaccttgccgaagacgatgtcgctgttggcctcggaagccttctggaagatggggccgaaggccttgcaggggccgcaccaggtggcccaaaagtccacgaagaccaggtcgttgcgctcgatggtgtcttggaagttctgtgcagtaagggttaccgtcgccataattgctccttttgtcgggccttggctctttccgaagcaaaccaatccttcaccaccagcattccatcaggcttggaagataagctcttggctcactcgccgcgcagccgcatccgggcttgaaaggtccgcccgggggcaggataatgggggcatgccagtgctacatgacgagatacccgacgactcggacttcgacgcgggccggaccaggggcgagttctccaacatcacgcccgaggacttcatccgcggctcaggccggggcaaccccccgggctggttggggccggaggagatagagtgggcccgtcgcaggatgcccatgccttacgtggaggtcgtgccagcgcgcaccgacgcgaccgggcgggtggtccaggtgggcaccctcctgtgcgtaggcgacgacgggagcatagaacgcaccctgatcaccggccgtgtgctctaccacgagtccatccgcgaggccctggcgcgcaacatctccaaggacctgggcgagctggccctgcccgagctgccggtcggcattcagcccttcaccgtggccgagttcttccccacgccgggcgtgtcggaattccacgacccccgccagcacgcgatcgccctgtgctacctggtgccggtcgccggggattgcaagagccaggacgagacgctggacgtggagtgggtggagccccactcggacatgctggacacgttcgccagccaaatgcccggcgggcatggcaaaatcctcaggcaatcgctcgcctgggccggggtgctctgagcgatcccgcgcaagacgcggccggtcggcgcttagggatgggcgcggtcgtttgggcggggcatagggcggaccgtgcggcaggggaagtccccagcaggccctatatcggtaacggaatcgagtggtcccccggctcagcgggacacgggcccacgagggcatatacagggcggcgcagagcgtaaatgaagagaaggtcaagcatgaagattgccaaccacgcctaccgtgaggaaggggagggaaccccgatcgtgcttctccacgcctttcctgtggaccatcggatgtgggacgagtgcgcccgcctgctgattgatcgcgcggaccgggctgggatggagcccttcccggtctacgcgccagacatgcccggcgccggcgacagccctgtgccctcggctcaggagagcgggccgaccgatccagacggcgcctacagccaggccctggaccgcatgagcgaggcgtacgcggacctgctgacctcgctggggcaccgggaggccatctgggtggggctgtcgatgggaggatacctggcggaggccctggttcgcttgcgcccgcagatggtggcgggcttggccctgtgcgacacgaccgccgacgcggataagcccagctcgcgcgccaaccgcctgcatgtggccgcccaggccgagcgggagggcaacgtgcatgccgtgatgagcttcgcccagtccggtccgggtgactccaccatcaagcgttcgcctgagtacacggcccgtttcaccggctgggtccaggatcagagcccggagggcatagcctggcggcagcggatggcggccggacggcctgaccagcgcgcaatcctaagccaggtacgcgtccccgccgctgtggtttgcggggaattggacccgtccagccccccatcctccatgcaggccattgtggacacgctgaggccagccgacccttccttcaccgccatagccgactgcggacacttcagcgccgccgaacgccccgaccgcgtggcggacgccctgctggccctggcgcgccgcgtggccgaccgccgtgccaaccactgagacacactgagacaggaaaggcctcccttgcaacctgatcaagcgtatttctcccccctcgcactgaccagtgccctgacctttttacccctggcccaatcccagctggattaccgcaccgagttgcgcggccggtccgacctcttccgtcacttgtgcggcggcgggagggtgcgggtcgtcctggttgatggtgagcgcatggctctgcctgcgcgcagtctggagagcagccgggtcggcggaggccagctgcgtctggcggccctggccggcgagtacctgcccagcggcctggcacccagccaggaccgacccagcgccctgtacttcctgggctcgctgcgcggtgagcactggtttgccttggatttgggcctggcccggcggctggctgatgacggacagggctcccgggaaggttcggccttcctggacaaggccggcggccgcttcgactggattggcctgtacgccttcgccccacggaccagcgggcgcgacgcgggactggccacctccgcactgtctttggccgcttggcacagccggcagaagcactgccccaactgcggggccccgacctggcctgaccagaacggctgggcccagcgctgcgagggcgaggggcaggggcgggtgcttttcccccgggtcgaaccggctgtcatcacctcgattgtggatagccaggaccgcctgctccttgagcacaacacggcctgggatccaggtttctactccctgtgcgccgggttcgtggaggcgggcgagaacttggagcacgcggtgcggcgagaggctatggaggagctgcgactgcccctgggcgaggtgcgctacctgggctcgcagccttggcccttccctgcctcgctgatggtggggttcaaggccttggccctgggctcggacatccacgtggacgggcaggagaccgaggacgcgcagtggatgacgcgccaggagtacgcagaggcgctggcgtctggtcgcatgaccccgccaggcaaggcttcgatagcccgtagcatggttgagcagtggtacgggcgcccgctgtaagcgtggggacggtcgtcgcagggtttacgcggcgccgcggggccaggggatgggcccgtggggtgagcgggtggaagaggcgccagccttccgcaggccggggtccttggtttataattgaatcaattggaaaggttatcgaaaggtgagctatggccgacgacatgcatggtaacacgcagaattcgtcttatggagctcaggacgcctacgcgggcatggatgcatatgcgggggcagtaagcccaggggaacgcacaacggtcattccacctttgcccaccgggttcggctcggctccggcgataccggtggggtcctacccggagggcatggtccaggacgccgctgcgacaggcgtggccaatggcatgggaacgccaggtatggacgctacggtcaccgtgccggtcttccagaacgcctacatgcagccatccggtccagaggacttcggcatggacgggggagccctgtccggggtgtccggggcccaaatcgcggacgaaccacgcaagcgccgtatttggccgtttgtactcctggggctgctggcggccttgattatcgccctgaccggtgggtacttcggtgcgcgctcgtactacagccacagggcggccccaggcatcagctttggggggcaaagcgtagcaggcaaggacgctggccagctcaaggatctggtggtttccaagaccgctgatacgcatatgaccctgaccgacggcaaaggcggtcgggccgcggcctcgctcaaggaccttggggtcaaggtcgacgccgacaagaccgtgtcggcgctgctgggcgccaagagcggcagcgacttcgctcgtatcaaccccttccagcgccagtccgtgcctctgtcgtactcgctcgaccaggtgaagatgaacgactacctgaccaaagcctttgtgagcaaggatcagcaggctgtgccctccaccatcgctttcgacgacggctccaaaaccttcacggtccaggaaggcaagaaagggcgcgccccgcagatggactcggtcaagaaggccgtgaaccgcagcgccgaagagcctggtggcgcccagtccgtagcgatcagttaccacgatgtggacatgcccatcacccgcgacgtggccacgcaggccgcctccgaggccaacaagcgtctggccacgccgatggcgatcgataacggggctggcgaccagttcacggtgcccaccgatcaggtggcccagtggatcaagccccagaccgacttcgacaagggcacgatggccctggcctacgaccaggacgcggtcaaggcttacgcggcgaccgagctgcccgccaagctcaacaagaacatggtgaccgagaagaacgtcaagaacaccaagggcgacgtggtggccgtgaccaccaaaggtgtcgatggcgtcaagatcaaggacacggacgccaccgccgcgcaaatcatgaaccagctgcaaactggccaaatcgcgccgatcaaggctgcggctgacatagagcagcacaaggaagagacccgtaccgcccgctatgacgtgcctgatggcgacatgtgggtggaggtcaacctgtccacccagacggccaccgcctacaagggaaccaccccggtcaagaccttcctgatttgctcgggcctgccgcgcaacggcgacgagtccgacccgggcaccttcttcatcaacatccgctacgatgtgcagaccatgcgcggtccaggctatgtctcgccaggcgtgcgctgggtctcctactacaacggttccgaaggtttccacacagcggcctggaactacgatgcgatcgcccacggggacgccgccaaccgtggctcccacggctgcatcaacatgtatgagcaggacgccaagtggatttacgacaactgcccggctggcacgatggtcaaggtcatcggttctcagccgaccgcgccggtgcgctgaaaccgcgcgcacagcagaagcatataccagagggcagggggccgggctggcgtctgcggtccccctccatgtagggtagagtcatgacagcatctcagaagaactcggagcgattgagcctacccgagcagttgcactattcacaggaccacgtgtggttggatgactccagctcaccggcggtgctcggcgtgaccgagtatgcggccgaacagttgggcgacctggtcttcctggacctgcctgagaccggcgcccacgtggaggcgggcgacgagatcgtcgagctggagtccgccaaggccgttgaacctttggtctgcccggtagccggcacgattgcctatgtcaaccgggccgccgccgacgatcctggtgtaattaactccgacccttacggtgaggggtggattctgaagctggagttggacgacgatcagcctgatttgatgagtgccgacgagtacggcaagctgatcgacttggcccagtaagcccagccagcaatggtaggcagctcaggcggaggggcccgaagcgccaagaagagcggggctaaggcggctcgtaagcccatccgggcccgccatgtcgccacctcattcgacgcggcctcccctcgggagcgtttcgaacgacaatccttgccggtgcgcttggcgaggatgggattgaccaccggattcgacatttgggtccggctttcaaccgcatgctgccggcgcttgggttggcatcctcgcgtggacccttatgtgggctacggaaccgagagctactcccggttgatctgcaggaccgtcctagcccctcccggctctttggccggctctctgagccggggaatccgcgccgccttgaccgtacccgccccccgcaccagggtgaagatagccattgatagcacgcctatcgagaccgttcaagtcggggactccgagctctacgatgcccccgactcccgacgcaacaggagcagccgctacgccttgtccgaccgatccggcttcctggacctggtggccgagcacagcttggcccctggcccgcatttcgtgacctaccgtgtggatggccggcctctcgttcccggccccctctacacggtggcctcctccactggaatcggcgtgatttcggacgtggatgacacaatcatgatcacccaggtgcccagcatgttcaaagccgcctacaacatgcttctggccaacccagtcaagcgcgcgtcggtgcccgggatgagcgtgctctacaaccggatcaacgacctttccccaggtatgcccttcttctacctgtccgcctccccgtggaacgtggagcgcacgatccgccgcttcttggaggaccacggtttcccacgaggccccctcctcctgcgcgacctggacccgaggcctaagactttcgtgccctcggctgtgcagcacaagcacgagttcatccagcagctgatggccgacttcccgcatatgcgcttcatcctcttcggcgatgacggtcagacggacccggccacctacgcgcaggtggtcaaacgctacccgggacgggtgctggccatcggcatccgacggttgagctcacgcgaggccggcctgggcgtcccgggccgttccagcgccgcgtcggtgcccgagatggacgtgccggtcttctacgggtccaccggcgccaacctgatgaagaccatgttgccctacctggagcaggctcgccgggacggacgcttataatcggctcatgacttgcccaaactcagcaccaccagccttcccccagccgccggcgacccccagccggccccacctgcgccaggtccacggcgatgccttcaacgacccctatgaatggctgcgagacaaggacgaccccgccgtccagaccctgatcaagaatcagaaagcctactgccaggcccgcctagccccgctctcagggctcaagggccagctcttcgacgagctgaaatcgcgggtggagcagaccgacatgtcggtgcccacaaggattcacggttactggtacttcgcccgcactcaggaggggtcccagtacgcggtccagtgccgtctgccggtggtcgatcccgatgactgggagccgccggtggtcaatcctaagggtcagtcaggctcccttccgggggaggaggtcttcttcgacgccaataaggaggccgaaggccacgacttctaccgcttgggcggcttggacttgagcgaggacggtcgcctgctcctctactgcgtggacaccaggggcgacgagcgctacgacctgcgcctgcgcgacttgtccagcggcgccgacctgcccgaccggatcgatcaagtgtcctccggccccgtcctcactccggaccgccgctgggtcttctacgccaaggtggatgaggcctggcgtccctactcggtttggcggcacgaggtgggctccagcgcggcagatgatgtgtgcgtgttcacggaagcggatgagcgcttttgggtgggcgtgggcctgagtttcgatgagagccagctggtgattgggaccagctccaagacgaccagcgaggtcctcctgctccccttggacaacccgaccggcgagttcaggcctttcatccccaggcgcgagggggtggagtacgacgtgtccttcgcttccttcctcggggcggggcctggtggggccaacctgccgctggctctggtctaccacaacgccgatgacccgaacttcagcgtccacctgattgacatgtccgcccaccaaccgccttacagcctgtctgaaggcacggtgctggcccagggcagcccctacgggtgcgaagccgctcctgagggtttccaaggcccggttgaccagccctaccgggacccggtcaacccggccatcctccagggggctcgcgggctgagcatcgaaggcgtggccatctatgaacggttcgccctgctgggctaccgggccgacagcttgatgcgcctggccgtcatccccatcgaacgggccatcgaggactaccgggctggccgcccttggcgcttccgggaggtcaagcccgccgacggttgggaggaccgggtctgggcggtagccgccggtgacaacccctcctaccaggccccgaccctgcgctatacggtcgcttcttacgccaagcccgccgagctgcgcgaactggacccggcgagcgggcatgaccgcctgctcaagcgcgccaaggtgctgggcgacttcgatcccgcctcctacggggagcggcgggtctgggttcaggcgcgcgacggggcccaggtcccggtctccttggtctggaagcgtggcctggtgcccggcatggaccaggccggtcccgaggggctgacccggttgaccttgagcgcgcctggcgacctgcgctcgatgccctggcctcggcccgcccagggcgccgaatctggagccgacgcgaccgtgaagccagccgctgccgtcgctgggcagggttcgcctctgttcatcactggttacggggcgtatgagatcgcctccgaccctggcttctcggtcggtcgcctgagcctgctggaccgtggggtcctctacgcttgcgtgcacgttcgcggcggcggtgagatggggcgcgcctggtacgagcagggccgcaggctgtccaagcggcacaccttcgaggacttcgtggacgccaccgccgccctgcaagcggcgggatgggcggatcagacgcgcacggtggccgaaggaggctcggctggcggcctgctggtcggcgcggtggcgaacatggccccacagctttacgcgggagtcgaggcggacgtgcccttcgtcgacgctctgacctcgattctggacccctccctgccgctgaccgtgaccgagtgggacgagtggggcgaccccttgcacgatgaggccgtctaccggtacatgaagtcatacagcccctacgagaacgtgcccgacaaggccgagcgcctcgccagcttcggcagcgagcacttcccccgtgtgatggccaccacctccctgaacgacaccagggtcctgtacgtggagccgctcaagtgggcggcccgccttcaggagagcgccgtcggggcggatgcgatcgtgaaggtggagagcgagggcggccacgggggagcctccggtcgctaccggcagtgggaggagctggcggaggagaacgccttctgcctgtccatcctgcggcctgatttggtttgaatggctgccaggggcggctttcaggcggcctggcggctatagttggaaccagggaagagaagaagtgagaccggggtcccaaggcctctgtccgccttgtgcgcgcaagacgatgcatacagggtgcagagagaatcaaaggtgggcgatgagcggaaagcacgctgaaggtaataagcagtctcccaaagcgcgacaggtgtcctcagcgcacgatgccggggtgagggccggccaaggcggcagtgcgcaaccaagcgcgacggtcagcggtcggacggatgcccggctttgggctcaaccctcgcaatcacagcaggagtcagaggctccttcaacttcgcccttctccacgcccacagccgcgccttcggccgtccatgcaggcgcgccgggtcaggcgagcccaggcgccgatcagtctttccgccccgcttgcagccaagcggctccctacggtcagagacctggaggattgacaccggacgggttctcatcggctgaatctccggcgggtgcttcggcgctcgcggaagccgggtggccttcccaaccccaggtggggtggccggtgcctaacatgccgtcggcgactacgcggccatcgcctcggcttgctgctgcccctagcacacaagcgaataccaccgagaatgactccgatgccgtcgctgcgagctacggcgccgaccaagagggattggcgggccccggcttccaggcaccggcttatgccccgtcctcatcctcccgggaaccgactgaatggccccagcagggcgtccagtcgccttgggctccgtcagcacccgcccagcaaagccagtcggctccctcggcccaggcaggtccttcagcgggctacagcgcaaacgctgacgttcaaccgcgccaccctgaggcccttcagccggggttcgcccaacccggctcctcgcagccggcctatggccagccaagcgtgaatcagcccgcctacgcccctgcttacggacggcccggttacgccccccagccgagttacccacaaggggtcccgtctccagcagccggccagggctggtcgccgtacgtccaggagcagcctcgccagtcccacagcaagctggtggccggcgtattgggcatctttttgggcgtgttcggcttgcagaacttctacttgggcaacaccggccggggcgtggcccagctgatgatctcctgcgtgggcgttttcttcttcttcagcgggcccatcgtctcctgcgcgtggggcatcctggagggaatcctgattctgatctccaaaccgggttcccgccgccatcaggacgcgtacggggtggagctgatcgactgaccgcagttgaggggaggggccatggccctgggcacgccgcaatcctaccggggggaatgcaaactgccggcaggcaagttgacggcagtgacgattcgtttgcaacgcggccccggcctgtccgaccagccctcaattggctcctgccgcatcaacggagacttcttcctggaggatgactcgggtcactccagtctgatcggcgatttggaacaagcgctgctggcgatggccccaccggtcgctgagcgggcggtggagggaaagctgagcggcctcatcgctgcccaccctggaagccacctgattggggccaacgcccatacgctgaccgtggcttacatacgcgcgctgcgcttggccgggctgcaacccgctgacgcggcaccgccacgccgccgaccccctaggcccagcggcttcgtgcgcgtgcaggacttggattcctaccgggtggacgacctgatggaccgctggcggcgcctgccgttgcgcatatgcgttgacacgccccggcccccggctgagcaagcggccctggacctggccctgaccgaggcggtgcgcgaccgtgtggaaccggccaccctgcgcatctggaacctgtcgtcgccggccgtcatgattgggcgcttccagtccctctactcggaggtggacacgcggcaggccaggaggatgggcgtgcgcgtggtgcggcgggtgaccgggggaggggccatgttcgcctggccttccgacgtgatcacctactccctgagcctgccttccgagttcgctcacggcttggagcgatcctggacctaccggctcaacgacctatggctgctcgaaggcttgggccacctgggagtcgagtccggatggtccggcatgaacgacatcgcctcgcccaacggcaagataggtggagccgcccagcgctggctgccggccgcaggcaagcgctcgggggccatcctccaccacacgatgctctcctaccggattgacgccggggctatgtcgcgcgtgctcaacgtctccccggagaagctgtccgacaaggccgtgcgctcggtccaggcgcgcgtggaccccctggcctcccggacgaccctgggccgcgcccagttgaccgacgccctgctggctaacttgatggccatgtcgccccgcgcgaccctggctcagctaggctcgggggtggtctcccggggccgcgagctggcctctgaacgcttcgcccaggaggactggacgaccagtatcgtatgatggttaaggactaccctcccgctaggcggcttcggagggctccgggcccgtatgagtcatgcgtatgacagcggaaggcggcgtccggcgagttcaatgtagattcgtgaagcgagacagaaagttggtcggcggtggttcgtaaggtcaacgagatagccaacgaggacagcgccctgctgctgaccccgctgttcgaacaggttccgcgcagtgaggcggatcagctcctgggcgctctgaagacgtacacactgcctaaaggggcctcgattttccgccagggcgataccgaccaccgcatgtacatgctggaacgagggcgggttaaactggttcgccagtccagcgatcaccgcgtccagctgctgagcatccacggtcgcggtgagattctgggcgagattccggtcttcgacccctccggcgggcccaggacggcctcggcggtcgtcatggtcaacgacaccaaggtggcggccttggagcgcgacgacctattcacttggctcaaccagcaccctcgagtggccgtggacatgctccaggtcctggcgggccggttgcgggccaacaatgagcgcatatccgacctggtcttcatggatgtgccgggccgcctggccaagaccctgattgacctggccacccgcttcggcgagccctttgagaaggggctgatggtgccccacgacttgacccaggaggagctggcccagctggtgggcgcctcccgggagaccgtcaacaaggccctgatggacttctcgaaccggaagtggatttctcgtaaaggtcgcacgatcatcatctaccatccgggcgctctgattcgccgttcccgcatgtgaaaccgcgctggcggtcgcttgtgaaccggcggcgcgggtgtcggggcaggtagagccggagttctaggatggaagacatgcctgaaaacaagaagtcgatgacggttcaccgctttctctcgctcctattggcttatgtggtcttctgcctggcgggcggagtggtggtctcaggtttcctgctgcccggcgtctatggggtgaacgcggccgctaaggccatgatgccctcgctgagcgtggagaacgtcgatttcaatgcgaacgacttgccccagcagtcccggctctacgcctcggacgggcacacggtgctggccaccttctacgcgcagaacagggtggtcgtgccgctcaagcaggtctccgaccccatgcagaaagccgtcgtggcccgtgaggaccgccgcttcttcgagcattcaggagtggacacccagggcgtcttgcgcgccttcatccagacctacgtcaagcagggcgacacccagggcggatcttcgctgacccagcagtacgtgaagaacgtgctgatgaaccaggccgaggagaacaacgacccgatcgccgagtaccacgcgcgcgaggagacgatcgcccgcaagatgcgcgagatgctcattgccgagcagatggagaagaaatactccaaggccgaaatcctccagggttacttgaacatcgcccagttcggcactaacacgtatggggtggagaccgcggcccggcgctacttcaacaagtccgccaaggacctggacgcgggggaggcggccaccatcgccgctgtgaccaagaacccagccaagttcgacccaacggtggaccccaaggcctcgcaggagcagagggacaccgtgctggatctgatggcccaggagggctacatcagccccgctgagaatagcgaggccaaggctaagcccctggagcagaccctccacgtgcagaatgtggacgctggctgccaggccgcaggcgacgcggcctttttctgcgactatgtgaccaagcagatcctcaactcgaaggagttcggcaagtcccaggagtcgcgtaacaagcttttgaaagagggcgggcttgacatctacaccacgatggatgtgaacgcgaacaacgcggctatgcacgccgcgcgttccacgatcccggtcgaggacccctccggcttcgaggtggctatcgcggccattaagccgggcaccggcgaggtgctgggcttcgggctcaaccgcatttacgacgcgaccgagaactccggcggcggcacgcgcacggccatcaactatgcggtggaccaggtggacggcggcggctggggcttccaagtgggctcaacctggaagccaatcaatatggtggcctggatgaaggccggcaagtcgattaaccaggccctgcgcacctcgacttcctatcccaagagctccttcaactgcaccggttcggacggccagcagtacggcttcggcactgattcctggcacgtggagaactccggaggcggcaccaccagccccgagtcccccctgcagggcctggtccgctcccacaacaccacccaggcttcgatggcccagcagatcggcctgtgctcgatcgcggacactgcccaggagatgggctaccgtaattcgcccaaagaccagatggacgtccactcgaccaactccttccagccgaccatgaccatcgggtcctcctccgcctccccgctgaccatggcgaacgtatacgccacgatcgcggccaagggcgtggagtgctctccgattgccatcaagcgggtgatcgataagcggggcaagcagattcaggtgccttcggccaactgccaccaggccattgacccggccatagccgagaccaccgcttacgcgctcaaccagggcgtggtccagcccggcggcgaggcgaacacgacccagctggacggcggccgcaagaccttcgccaagaccggcaccaacgaggacacctacatgctcaccggaggtttcgtgcctcaggtggcctcctacgtggccgtgggcaacgccgagggctcggtctccttcaatggcaagaccatcaacggggtctcccgtgggtcttggtacggcatgtacatcgccacgcctgcctggaaggccttcatgaacagctatctgagcgcggccggcatccctgcggacaacagctacggcaaccccgaccccaggtacacgtctggagcccagcctcaggcccagaacgggcagcggcagcagcaaccgctacagcagtcggcccaaccgcaacgccaatgaaagcgctggcttaggcgggtccgcgagccgagcgctgaagggggtgcgtggctcagttcggcggagcacgattgcgttaagaaagccgaggttgggtcgtggcggaagattcagggacgttcagcggggcacgcgcgcgggagttcagcgttgaccggcacgcttcgtcgggcggggtcggaaacggccgtgcccccatactcgggcactgctggaccttgcgtgtcgactgcaagatgggtctgcctgatcgggcggcgtcctacccccaggcatgcttgctcatcgcttgcgggggcaagcgatgagcccttcacaagcacgcgcccaagcggcagacgccacccacccgccccgttccgggcctcaggtggatctggcgtccgggcggggggtcctggtcgtcatgcctacctacaatgaggcagacaacatcgagcgcacggtcggacaggtcctggccgcttgtccccaggccagggtgctggtcgtggacgacgcctcgccggacggcaccgggcgtctggccgaccgcttgcgggcccaggatgagcgggtcaacgtcatccatcggcagggcgcgcgcggtcttggccccgcctacctagcggggtttgcttgggggctggagcgtggattcgaggtcatctgtgagatggatatggatggctcccaccgggcccaggacctgccccgcctactcgccgtgctggaagagcgtccccaggtggccctggttatcggctccaggcgtgtgcggggtgggactaccgtcggctggccctggtaccgggacgtgatttcgcgggctggctcctggtacgcccgccatgccttggacatccgggtgcgcgatgtgaccgctggcttccgcgcctacaggtcctgggccctgcgcggggccgactttgagagggttgaatcctccggctatgtcttccaaatcgacatgctgcgccgggtgcttgaccaggggggtattgtggtcgaagtgccaatcgtgttcgtcgagcgcaccctcgggtcctccaaaatgagtccgtcgatcgtggcggaagccatgcttcgggtgactgcctggggctgggacagggtgcgcaggggcctgtgaaggctcgcctgacgcctgggtagccggcgggagcgctgatcgacgtgtcgtttgaccgtgcatgtttgtgcgttcgctgggttgctaagggcagtaagaggcgctgatgtgcgtttctctcctggatggtcgcattttccttatggctctaaggtcaagagcggcgcgctttcgtgggcccgtgtccggggcttggagggggcttgccgtcggcttgctcatttgggcgaatgtgtgcgataatgttcatatgatttcctcacagcgccagcatttgatcctcaaccgccttcgtacgcgcggcgcggtgaggataacggcgctgtccaaagagcttggcgtctccgccatgaccatccgccgtgacatcgccgacctggccgacaaggggctcctgaaacgggttcacggtggcgccgtcaccacctcctccctgctggccgagcctctcttctcggtcaaatcccagatggacatggggctcaaagacacaatcgcccgccgcgccatctcctacgtctcgcccggcgacgtgatcgccatcggcggcggcaccaccgcctacgtcttcgcccaacacctgctcgaatcgcgccggtccgagggcatcacgattctgaccaactcgattcctgtggccgaactggtccaggccatggagagcaaggaggtggaggtcatcgtcactggaggcgtgatcacccgctccaactcactggtcggccccatcgccgacaaggtcgtggcgtccctgcgcgtgaacacggtgttcctgggcacccattcggtctccatcccccggggcttcctgatgcctaactcactggaggccgccactgacatggcattgatggacatagccgaccgcaccatcatcctgaccgaccacactaagtggtcttgcacctcactctcccttttcgcctccttcgaccaggtgagcaccgtagtgaccgacgacggcttggacccggctgccgcggatgagacccgcgctttggtgcgtgagctggtcctggcttccaccggcggcggcgaggcggacacggccccgggccccctggcccaggagtgaagcgggaactgtaaacccaacgaacaggaaggcaggttcagatgagccggagcgggcaagagtcggagtcgacagggtacgagcctcagcggtaccgtccgggggagtatgcgcgcgagcacatccgcatcacgcccaccttgctggctgatgggcgccagttcttctacctggacgatgaccccgagcatgtatccggcgccaagacccgtgagctcaaggacccccgtcacctggccgatcggttcgccccaggcgtggacgcggaaggcaagccaatcccggtgcaggccccgcagatgcgccgcgaccccctgaccggcgactggattcccatggccaccgcccgcatgaaccgtcctatcaccgccggacccggcgctacggccaaaggcaacccgctggccgcgcgcaagcctggcgacccctaccaggacggcgaagtacccgacaccgactacgacgtggtcatctttgagaaccgcttcccctcgatgatgcaggtgcctggtctggatcctcagaccacttacgtggatggcaaccagctgtggccggtgcgcgaggccaatggccgctgcgaggtcgtctgcttcgaccccgacgagaattccctgcccgcccaactgccggtcaagcgcctgcgtactgtggtggaggcttgggccttccgcacggccgaattgagcgccctggacggcatcgagcaggtctttcccttcgagaaccacgggcaggagatcggcgtctccctggcccacccccacgggcagatttacgcctaccccttcattcctccgcgcatggaggacgaactcaaacagagccaggcctaccacgagcgtaccggcggcaacctgctcggcgacatcctggccgctgagctcggcgcgggcgagcgcatcgtgatgcgcaaccattcctgggtggcctatgtgccggccgcggcccgctggcccctggaggtgcatgtggccccggtgcgcgacggagtgctctccatcgaccagctggacgaccaggagcgctgggacctggcccagatgtactccgccctgctcaaacgaggcaacgccttcttcgacaagggcgacggcaagggcatggacctgccctacatcgcggcatggcaccaagggccggtcaaggatcctcgcaggtcggactaccgacttaacctccagttcttctccttccggcgggcggtgaataaggttaagtacctggcgggctccgagtcgggcatggccgcttggatttccgacaccacgccagagcggatcgccgcccgtttccgcgaaaccggaccggtggacctgagtgatgaagactgatgccagcagcgccggcaaccgttccaagccttgggcaggcaatgggcgcgctggacaagcggatgcaaggacaagcgcaaaggagcgaataactatgagcgcagttgaattcgtcgaggccctgtccgaagggcccgatggggagggcgccagtcaagccggcgcgctcttccagcaggcttacggccaggaacccaaaggggtctggtcggccccaggcagggtcaatctgattggcgagcacaccgactataacgcaggcctctgcctgccaatcgccttgccccaccgcaccttcctggccctgagcccacgggatgacgaccaggtgcgcctggtctcctcattcgcgcaggaccgggttgagcaaacgtccctggagggccttgaggccggaggggtggaaggatgggccgcttatccagtgggcgtggcctgggctctgcgacgggctgggttcgggcaggtgcgtggattcgacgcggcgttcgtctcgtgcgtgccggtgggctcgggtctgagctcgtcggcggccatgacctgctccaccgcgctggctctggatgacgtgtacgggctgggcttcggtggaagcgacgcggggcggctgacgctgatcgacgcggccatggtttccgagaacgagatggctggcgcttccaccggtgggctggaccagtcggcctccatgcgttgccaggcgggctacgcgatcgagctggacttccagcctgggctttccgcgctggaatcagccaagcaggtgccttttgacctgaggtcccgggacctggagctgctggtgttggacacccaggccccccaccagctcaacgacggccagtacgatgcccgtcggcgctcttgtgagctcgcggcccaaacgttgggcgtggagaacctgcgggtggtggccgaccaggtggaggccgccgatgaccctgagcgggccttgaaagacgtcttggataagctggatgaccctactcagcgcaagcgtgtgaggcatgtcgtcactgagattgggcgcgtgggcgagttcatccgggccttccgcgcaggcgatatccggcgggccggggagctcttcaacgcctcccatgattccctgcgtgacgattatgaggtgaccgtgcctgaactcgacctggcggtggatgtggcccgggccaacggcgcttatggggcgcgtatgaccggcggcggcttcggcggttcgatcatcgccctggtggacgccggacgctcgcgtgaaatggccgctgcggtggccgaggaattcagtcgccggggcttccgccagccccgtgccctggccgcgctgccctcccagccggctgagcgcgaggcctgattccgtaccggaacgttgatatgcgttgggccccgaccgtgccatacggccggggcccaacattgtaattcgtgctagcaggcccttacttcgccccgctatgggatcacttgacgcgcttgatcagcatcacacagacggcggataccacggtcatcgcgatggcgacggggaagaccagactgtaaccgccggcgatggccaccaaggtggacgtgaagaccgagccgatggcttggcccgcgcaagtggcgatgttgatgaagcccagatccttgcccgcagtctccttgttgggtagcacatccacgttcaaagcctggtccacggccgagtacatgccgtagccgaagcccgcgatgccggcgaacaggagcatgcccagcgaggagcgcagcacccaaggcatggcgataccgatggcgtagagggcgcaagcgaagacgatcggcggcttgcggcgcttgatcagatcggagatcgggccggacagggccgtagcgatcagcgagacgaccatggtgatgaccgacatggtggcgatcgtgcctgctgcctgggtcttggtctgtccgatgtggtcctccaggatgtacagctggtaggaggtgatcatctgataagcgaccaggagtccagtgcggcataggaaggccttccagaagtccgaggcgcccttgatgggcggggtgaaggcgtggacgatcacctgtccgatgggctcgtccttgcgaggctcggtcttgttggagggctcccgggggatgatggccatggagagccagccggccagcaggagggagatgcccgagaccaggaagccggtcgtggtggaggagatgaaagccgaggccagcagagtgcccagtccctggccgattacggcgccgcctccgaaggccgccgaggcggtcgcgcggtccttgtcgggcacgcggtcggagaggatggcggtgattggggcgatcatcatgttcagaccgatcagggagacgcagtaggcgatgcccaccccgatgcccagggtcggcaggccggtggcgtagaaacagacgccggtgagcacggcgccgctcacgatccaaggggtcctgcggccgaagcgggagcgggtgcggtccgacatggcaccgatgaacacgttgatgaacatggacaggaccgcgcccacgctgttgatttggcccaggagggtgcttgggtcggcgatgccgatgtctttcaaacgctggggcatcagcacactcgccaccatggtgaagcccacatagagcagggtattgtaaatgaaaaggccgatgatgtagcgggccgcggtgagcgtggagcccttgccggacctttgcggcgcctgggccgttgtttcaggttgactcatgggaaatccttagtcgttagtgggatggacggttcagtcgagcatcatccaggcggacgcgtcctggggaagcctgccctggtcgtccaggggctgggaggtgaggaggaccttgccttggggcagttccacggcctcgcggctgaagttggtgacgttggcccagccgttggcccgtgcgtaggcgatcacgcccccggtcaggccgttggcgccgtccggcagcccggaggagcggtcgaagccatccagccagcgcagggaggtgtcctcgcactggcactggtggcgcagggccaggaccttgcggtagtgggagagcatggagtcgtcgtcgccctcttcggcggtgaccgcatagtcggcgaaccaggccggctgcggcaggtgcggggtggcgacaggctggccgtcctcgcactggtccggtgagaagccgaaggtgccatccgcgtcggaggtccagggcagaggcacgcggcagccatcgcggcccttcttggtcagggcctgacgggtgccggacgcccaggggtcctccagctcgttccaggggatgtccgccacctcgaacaggcccagctcctcgccctggtagacgtaagcggaaccgggcagggccatctccagcatgatcgcggccttggcgcgcttggtgcccagctcgcggtcctcgtggtaggtccttccgtcgcgcaggagccagtcgttggcgattgcgtggtacaagccgttgtcggtctccacctggggcagtgcgtaacggctggcgtggcggggcacgtcgtggttgctcatcacccacgtggaggtggagccgttggtgcgggccgccaggtcgatgccggcctggatggcgtcatgcagctcagcgcgcgaccagttgcactcggcgaaggcgaagttgaagacctggcccagctcgtccggacgggcgtacaggtgctgccgggaggaaggcacccaggcctcgccgaccgcgaaccgggcgggggtgtacttgtcgaagacctccttgcgccactcgcggaagatctcatggacctcgtcgcggtcatagaccggatggctgccgtcggtcacggtgatgtgcatggcatccacgtcgtagtcgtccaggtcgtcgcggtccaggtccttggccaggccctcggccacgtcaacgcggaagccgtcggtgccgtggtcgcaccagaaggtcagggtcttgaggaagtcgtcgcgcacctcgcggttgtcccagttgaagtcgggctgctccttggcgaacaggtggaggtaccactggccatcgctcacacgggtccaggccgatccgccgaagttggcgatccagttggtggggggcagttcgccgtgctcgccccggccgtcgcggaacacgtagcgatcgcgctcaggggagcctgggcccgccttcagggccgcttggaaccaggggtggaggtgggaggagtggttgggcacgatgtccaccacgactttgatgccatgggagtgggcagcctcgaccatggcgtcgaagtcgtccatggtgcccagctttgggtccacatcgcggtagtcctggacgtcatagccgccgtcggccagctccgaggggtagaagggggagagccagatggcgtcgatgcccagttgggagaggtagtccatttggctggtgacgccggctatgtcacccaagccggagcccgtggagtccttgaaggaacgggggtagacctgatagacgacggcctgcttccaccagaggtcaactttggtaaaagcgcttgcattattgttggtatcgttgcggtcgggcatagtgaatcctcactgattgtttagccaatactctagtgttttgccggttctaggctcttccttgacgtgtccttggccggacaatttaagtaataacgcttgcatttcgtcttgtcaagtggtgaagagggagggctgcggccgtggccatgccagtcgccgggcctagccggctgctagcatggcccatgaggcgtgggccaaggaagagggcggaagtgggagcggacagaggaaggggcgcgagcatggtacgcgtgaccctgcacgatgtggcgctcgccgccggagtctcggattcgacggtatcgagggccttgcgcgggttggacaaggtggatgagcgcacgcgcgagcgggtgcggcaggaggccgaacgcctgcatttctcgttctcccgcaacgcctcctcgctcgcgtccggcaagaccatgcgcgtatgcttgcttttctccgacaagctcagcacctggttcgactcgtccgtgctgcagggcgcctacgaggtgctgtatccgagccgctacgacgtggtcccctgcaccgtgagcacctaccaacagctgggcgccttcttctcgcggctgcccgccgatcgcaacgtggacgcgatcatcgtggcctcgatcaaccttggggagcgcgagaccgatatcctcaaacggctcaccatcccgacgatcggtctggattccaggaccatcgacgggttcgacgcttccgtgctcctggacgaccgcaagggcatgcgcgacgccgtggccttgctcaaaggactggggcaccggcgactgggttacgtgggcatgcctgcgcctggcgacttccaattcagctcgcagctgcgcggtgacgccttcatggaagcggcgttgggcatggggatggacccggccgacctgcaccggatcgacgttggcaaaacggctgactaccgctcatacgaagaggcggtaaactctggggcggcgcggattctggccttggacccgatgcctaccgccgtgtgcgtggagagcgatgagtacgcggtggcgctggtccgggtcttgcgggagtacggggtgcgcgtgccggaggacctgtcggtcgtggggttcgacgatgccgccgtcgctgctgccgccgatttgacgaccgtgcatcagaacccggaggagatggccaaggatgctgccgggaaggccttggagctcatgcgggggagggagcccggcgaacggcactccatggccgagccgatcctcatgctgcgggggaccacggccagggcgccccgggggcgtgggtagggccggtcagcggccgccggcgaagttcagctgacgccaggcctcatagacggcgatcgaggcgcaattggtcaggttaagcgagcgcaggctgggacgcatgggtaggcgaacctgctcggccacatgcgggcccgccatgatgtccatcgggtccgggatgtcgccgggctccgggccgaagagcaggatgtcgctgggccggtagtccacttccgtgtagagcttggtcgcgtgtgcggtgaaggcgatgatgcgcgaatccggcatggtgcgcaccaggtcgtcgaagtccggatgaaggactacatgggccatgtcgtggtaatccaggccggcccggcgcagtttagtgtctttgaggttgaatcctaagggctccaccaggtggaggatggtgccggtcacagcgcacaggcggatggctgatcccgtgttgccggggatcctcggcgagtagtagcacaggtggggcgtggaggtcgtctgcttggcggcgtcctcggcccgcagcatcgcatccgtgaccgcgattgggttgccgtgcgcgtcagtcaccagctcgtccggtccatacccggctttgcgatagccatactcatacatgccctccacccgctcctgcgactggttggcggtctcatgctcgcattcgttcatggtcccaaagtaaccgtttcaagcgacagccgggggcagacgcggaaaagtcaggagcgctacggacaatgggtgcttatgacacagacggcgcaggtggaactgacggacgcgcggcgggcctatcggttgctcgcggcctggtgggaggggaacgcgcgggacttgccttggcggttcgggaggaccacgccttgggggattctggtgtcggaggtaatgagccagcagacgcagatgagccgggtggtcccatactgggtggagtggatgcgggcctggcccacgcccgaggcgctggcggcggcgagcggcgcggaggtgatcacggcctgggggaggctgggctacccacgccgggccctgcgcttgcaggcttgcgctaagaccgtggttgaggagtatggcggcaagcttccccaggattacgagactttgctgactttgccgggtgtgggcgattacacggccagcgcggtggtgtccttcgcctacggcaagcgaatcgcggtgattgataccaatatccgccgggtgcttggccgggtgttcgctggtaaggagtcccgtggcggagcggccagcgcggacgagcggaccttggctcagagggcgctgccggaggatgacgctgaatcggtggtgtggaaccagtcggtgatggagctgggcgcgaccgtctgcgccgctaagtcgccggcttgcgaggaatgccccttgaatggcatatgcgccttcctggcggctggcaggcctggactgggggagcggcgcacccggccccgccagagattcaaggggaccgaccgccaagtgcgaggcctgattctagccgccttgcgcgagttgccccctggtggcagtttgcccatcagccgattggatagcctgtggcctgaccaggcccaactaggcgcatgcctggcctccctggatgaggatggcctggttgagatacaccaaggcggctcggtcagtctgcctgagtgaccgagccgcctggaaagcccgccgaagaggtggggtaaagcggcctacagatccttgtcgaaacggtaataggtcttgtggaaaccgttctcctcgtagaactgatgggaggcggtgtgctcaagccgcgagcacatggtcagcagtccgcagccggtgtccttggccagctgttcggcccaggccaggagttgatcacggatgtccttgtcttggtgggccttggagaccacgagctccttggtctctgccacgcgcttgccgatgtggagctgccaggtgcacaggatgcccacgaaccccatcacctggccgtcctcctcgtagatgcccagcttgtggtcgaagttctccagctggctgatgtaggtgcgggcgaacatctggtaatccagggtgttctggctggattcgctaatcaaggcgtagacgtcctttaaatccgccgtggtggctgctctaatcatgaggttccgccctttcgtgttctttcgtgcgtccttgcaggccggttcagaccccggatgccttgggtgggcgcggtacgcccagtagggactatcttactggggcccgttctggggctggatgttctgtgtaccaatgtgggtcgattgccgagcccggattgatgtgcttcgggtcgttgagggaaagggtggtttttcctcatgcttatataagcgacacttatgcaggacgcgacgacggctccagggtgcgacaagggagttgggtcgtcagtcacggaccataccgaatggagggcaactgtgaacatctacttagccatacttggtttcgcgaccatgatagtcatcacggtcgtgttactgaaaaagaaaatgagcatcctgctggcgttcacaatcattcccttggtggctggcctgctggccatcctcattaccgggggaagcccgctgctgattggcaagtggatagagaaaggcatagggaagacctacagcatcaccctgatgatgatgttctccctgccctatttcatgctcatctccgacacgggcctgtttgacgacatcgttaaaggcatcatgcggcgggtcaaggtctcggcgcccatcgtatgcgtgcttaccgtggtcgtggcctgcatctgcgagctggatggatcgatcacctccgtcttcctaatcaccgtccccctgatgctgcctttgttcgagaagttccacgtcgacaagcgaattctgcccttcctgatctccgttgccatcctgatcatgtgcaacacgccgtggaacccaaagatactgcgcgcggcgaccttgatgggcaacaagcagggagctccggcccacctgttcatcaagctcttgcccatccaactgttcatgctggtcctgctgattgccatggctgtgtacttcggcctgcgggcgcgcaagggcaacaaggaggaggtgaccgtcagcaatgaggagttgctctcccagttcaaggacaccgagctgaccaagcacaacatgttctggtggaacctgctgctgaccgcattcctgatcactgtgctgatcgcgataccttccatcccgcagtacttcgtgttcgcgttcggcctggttgtggccctggccatgaacttccatgacctggaccagcagggcactcttctgaagaagtacgcctccacgctcttcccggtcgccccagcggtgctgctgtccggcgtggtggtcggcgtcatgcaggagagcggcatgctgaacgccatggtgaaggccctgatggcgatcgtaccctcggcaatcggaccctacttctacatcatcatcgccctgttcagcaccccgctcatgctgctgttcaccaacgacacttggttctacgccctcatgccgctggtggccgccttctcggcccagtactcggtcccgattgatgtggtgatcgcgaccctgttcatgaacttcggctcgatgatctcggtcatcgcccagccccagctttacatcgccaccgacttgaccggcatcacgatcgacgagcacatcaagttcagcttctggaagctgtggggcatcaacatcgtcgtcgtcatctttggtgtggcgacgggtgtgttccttccctaagcccgagctcgggaggagtcgttcggggggtctgtccggtagccgggcaggcccctcctgcgtttgaagcgcaggtatttgcgcagggtgaatgcagcggacaataccgcgtagtccttcaatacgcgggggttgtacccggtctcgctcgcgatggtgttcagccggttctgcatggtgttcttgtgcaagtacagatcgtcggcggcgtggatgatgctgccgttgtggcgggtgtaggcggcgaagatggtctggaagtcgtcaatgcgtcgatcgttcaggttgccgaacaccctatccacgaagccttgcgcctcttcgggacttagcgcgctgaccaggcggcccaggtccaggtcggcgaagtcggtgatgctggtgcgacgggtgaacagcagccagtccagcgttcgctcggcctgggagtagcttttccagtagtcttcgtgccgcggctcccttccgcccattccgaacgccagttgcaatcccagccggtccgcaagtgtctcctgcaggtccttggccaagtcctcggtcgtatcggggccgtcctccggcaggtccaccaggaggctcacttgctggtgggagacggagagcaggcagtccggtcggtcttccagcttctgggacagtaagacgaacacgcggtcctggccctcgcccaggtcgccctcctggggtccgcccaccacggcgcgtcgcggccggtccagctccacgccaagcaccgaggccagataggcggccaatcctgggtcctgtcgccgcccgctcagcacgttgacaaggttcgacatcatcatccggtggtcgaactgggtgaccttctccatgttctcccggatcagaatctcggtcatcttcttgatgatgttgccgaaaggctccacttcctcgcgtcggccggtgatgcctatcaccgccaccaccgagtcattgagcaggaccggcacgttgatgccgttcctggctccttcgaactggtgctcattgtcgatggagatggtgtgcttgacctccacggccagtcgggcgccgtcgtggccggtgccgatccgggagcggtcggtgctggcgatgatggtgccgctggtgtcgaacaggttgatctcgtggttaagcacgcctttgatgttgctgacgatggtctccgcgatctgtgggtcgatgtccatggtctctcctgaagccggtgctgcaaaatatagtacacggaacatttttcctggagcgggggcgggtcattcgagctcgtggactagtgcggaaacgggcttggagaacccataatttacgtataaaagctttggtgttattcgacgctatggatcaacgaatggagaacagatgatacctaccgttgagactatggaagtcattccggttgcgggctatgacagcatgctgctcaaccaggccggggcccaccagcctttcttcacccgcaatgtagtggtgatgaccgattcggacggctacacaggcgtggccgaagtgcccgggggcgaggtcatcacccggcggttgcggtcttgcatacccctggtggaggggaggcccatcagccactacaagcagatcgtccaagagtgcggccggatgctttccaaccaggtcgccggcccggtggtcggaggggctgagaccgcccacgcgctgattttcaagaaggtgacgaatgtggtcaccggcgtggagacgcctctgctcgacatcctgggcaagcacatggaggtgccggtcgcggcgctgctgggcgacggccaggtgcgcgaccgcgtgcgcttcctcggttaccttttctacataggcgatcccgatgccaccgacctgccctacctgcgccatgacgatgacagcgacacctgggggaggagccggcgggaggccgccatgacccccgaggccatcgtggcccaagcggaggcagcccaggagcgctatggattccgtgacttcaagctcaagggcggcgtctttgagggcgaacgggaaattgagacgattcgccagctcaagagccgtttcccccatgcccgcattaccatcgaccccaatgccgcctggtccctggacgaatccgtccgcctctgcaaagggatggaaggtacgttgacgtatgtggaggatccttgtggtgcggaggatcgtttctcggctcgtgaggtgatggctgagttccatcggcagacggggttggcgacggctacgaacatgtgtgatacggattggcgggagatgaaggcggcgattcgtttggattcggtgacgattccgttggctgatccgcatttctggaccatgcaggggtgtgtgcgtgtggctcagttgtgcaatgacatggatttgacctggggcgtgcattccaataaccatttcgatatctcgttggctatggtggcgcaggccgcggcggcggctcctggtgagatcaacgcttgcgacacgcattacatttggcaggatggtcagcatctgaccacgaacccgccggtcatcgagaatggcgaggttgaggtcaggcgtgatgtgcctggtttgggtgtggaggtggatcgggccgctgtggaggccgcccatcagctgtatgtggacaatgactgcggcacccgtgacgacgccgtcggcatgcagtacctcatccccggctggcagtacgaccagcatcggccagccatggtccgttgaagcaaagttaagttttagaggcaataccctatttgaatcaggagtgtagacatggtacccactattgaaaacatggaagttttccccgtggcaggttatgacagcatgctgctcaacctttccggggcccacgggccgttcttcacgcgtaacgtggtcatcatgaccgactctgacgggtatgtcggagtgggggaggtgcccggcagcaagaagatcaccgatgtgctggaggaggtcaagcccatggtcgtgggccagccgatcagccagtacaagaatatcgtcaccgccatccacgataagtacgcggcgctcgacaaaggagggcgcggcgcccagaccttcgacctgcgcaccaccgtgcatgtgcagaccgccgtggagacgcctttgcttgacatcctgggcaagcacatggaggtgccggtcgcggcgctgctgggcgacggccaggtgcgcgaccgcgtgcgcttcctgagctacctgttctacgtggccgactatcgcaagaccgatctgccttacctccatgacgatgacaactccgatgattgggggcgcatccgccgcgagcctgccctggacccagatgccatcgtcgcgcaggcccaggccacccacggccgctacggcttccgtgacttcaagctcaagggaggcgtgttcgacggtcgagaggagatcaaggcgatcaaggcgctgaagaaggccttcccgaacgcccgcatcaccctggacccgaacggtgcctggtccctgcctgaggcggtggacctgtgccgcgacatggtgggtacgttgacgtatgtggaggatccttgtggtgcggaggatcgtttctcggctcgtgaggtgatggctgagttccatcggcagacggggttggcgacggctacgaacatgtgtgatacggattggcgggagatgaaggcggcgattcgtttggattcggtgacgattccgttggctgatccgcatttctggaccatgcaggggtgtgtgcgtgtggctcagttgtgcaatgacatggatttgacctggggcgtgcattccaataaccatttcgatatctcgttggctatggtggcgcaggccgcggcggcggctcctggtgagatcaacgcttgcgacacgcattacatttggcaggatggtcagcatctgaccacgaacccgccggtcatcgagaatggcgaggttgaggtcaggcgtgatgtgcctggtttgggtgtggaggtggatcgggccgctgtggaggccgcccatcagctgtatgtggacaatgactgcggcacccgtgacgacgccgtcggcatgcagtacctcatccccggctggcagtttgatcccaagcgcccttcgatggtgcgctgaattatctagactggtatcggagaaaactggagtggagagctgaatgatgagcaagcatgatttcgctgggattttcgtgcccattctgacgccaatcaatgggcatggcgcgatcgacgaagccaaattacgtcggcagaccgacttcgtgattgagcatggagtggatggcatcctcgcttttggcagcaattccgagttctacatgttcgaggaccaggagatgctggatgccgccacggtcatcctggatcaggctgcgggccgtgtgccggtcatgttcggcgtgggccacatccgcaccagcagggcggtcgcgctagcccaggcggcggccgggttggacgtggcggcggtctcggtgctgcagcccatgttcatcgagccgaccaagcaggcgctctaccaccactacgcggccatcgcccaggccatcgcgcccacccccatgttcatatacaacaaccctgggcgggcggggtacgcgctgtccatcggcctgatggtgaggctggcccacgacttcgggaacatcatcggagtcaaggactccagtggcaacatcaccaatatcgaggagctggtgaggcgggacgccgacatcgagttctcggtgttcgccggtaaggacaccatcgtctttcccagcctgtgtgtgggggccgccggcgcggtctgctcgacggccaacatcttccctgatttggtctgcggcatctacgacaactatgtggctggagaccagcgggcggcgctggctgcgcagttcaagctcaatcccttgcgcatatcccaggacgcggccagcttcccctcgcctaccaaagacatggccaatctgatgggcatggatgtgggaccctccatcctgcctactgaggccgccgagggcaaggccttggaaggcatgaaagcggccatgcgcgagaccgggtacttggactgagacaggtcgggtgcgagctacggggcgcaagtcgatagggagagctgctgagcatgagagatatacgtgtcttgctggcggtggactcattcaaagggtccgccggcagttccagggtcgaggacctcatcgaacttggtgtgcgccgggtcaggcctggggccgaggtgttgaagtatccggtggcggacggtggcgaaggcacgcttgaggccatcatgacggctcagggattccaagggcggtccgtccgggtgcgcgggccactgggtgaaccggtctcggccaagtacgccctggggcccggacaggtcgctgtgatcgagatggcccagtccagtggcttgggattgatggaccagtccagtgagaacgcccgcaaggcctccacctatggcgtcggacaggtgatcatggacgctgtcgaggcgggcgcccgccatatcctcgtagggctgggcggcagtgccacgagcgacgggggcaccggcatggctaaggcgctgggcgtgcgcttcctggacgctcaaggcgacgaagtggctgatgggctggcgggtctggaaagcttggtcgccgttgatgagtctaggctcgacgcccgcctgcgggaggtggaggtcaccgccctgaccgacgtttccaatcctctgaccgggcccgccggagcggtgcatgtctacgggccgcaaaagggcatgggcgcggaagagttggacaagctggattcctggatggatgcttatggacgggtgctgcggcacgccgggcatgacgtggccaacttgcccggagctggcgcggctggtggtctgggagcggctttggcggccttctgcggggcctcgatcgagagcggcatcgaccaggtgctcgacatgatcggcttggaggacgtgatggacggggttgacctggtcatcaccggcgaaggccggatggattcgcagtccgcccatggcaaggcgcccgtgggggtggcccagcgggccaagcgccatgggcttccggtggtggcggtcgtgggcagtcgggccgatgacctgggggacctgtacgagcgcggcatcgatttggtgatttccgccgtcactcagccgatgagcctccaccaggcgatcgcacgggtggacacggccctgccgcttgcgggggaaagcgccatccgggcctaccttctgggcgcgccgaaacgcgcgtgatcgccccggctacgagacttgcggccgatcccggcgggactgggtgtggtcgcgactgcatacatgcatgtaaggaaacaaaagaaaggaacagcaatgaaggttggattcgtgggactgggcatcatgggcaagcccatggccatcaacgtgctcaagaacggctacgaggtggtggcgtacgaccgcaacgaggccggcatctccgccatcgtcgaggctggtggccaagccggagccaacggcaaggacgtggctgagcgcaccgatgtggtcatcaccatgctgcccaactcacccaatgtggagagcgccctgttcgacgagggcggcatcgccgagggcctgagtgagggcaaggccgtcatcgacatgagctccatcgcgccgctggcgagcagggatttcgccaagcgcctggccgagaagggcgtggactttatggacgcccccgtctccggcggtgagcccaaggccgtggacggcaccatcgcggtcatggtgggcggcgagcaagccgtgttcgataagtacgagagcctgctgaagaccatggcctccaccgtcaccctggtgggcggcgtcggcgctggcaacatcaccaagctggccaaccagatgattgtggcgattaacatcgcaggcatctccgaggcgtactgcctggccaagaaggccggcgtctcgcccgagaacgtttacaaggccatccgcaccggcctggccggcagcgtggtcatggaccagaagtcgcagaagatcttcgacggcgatttcaaccccggtttccgcatcgagctgcacattaaggacctgcagaacgtgatggacaccgcccactcggttaacgtatcctcgcctttcagcgccttggccatggagatcatgcagtccctcaaggcccatgggcacgagaaggaggatcacagcgccgtggccgaatggtatgagatggtcaacgacatcaaactccaggaggactgagcgtcagacgtcccggcctatgccgggggagcagtgcgattgattgacctgggccgtgcgtgcgcggtccaggtttcgcgtatccgccaggtcagtagaatgggagggtatggagaaaagaaacgtcagcgcggaacagcgcagggtctttatgcggcggcgcatcgtagcggggctgattgcgctggcgctgctggccggactcgtctggggcgtcatggccggggtgcgttcgatcaaagcgtcgcggcaggcgggggcacaggcttcggcggcccagtcatcggccgcggcggctgggaagagcgctgccaagagcggaaagggcgaagcgaaggacaagaagtccagcgtgcccacctgcacaccctcggacctggagctggccctgaacgctcccgaaccgtcgaccacggtgggcggctatgtggacttcaccgctactatgcggcacaagggctcccgcccctgcttggtggacggatccaacgcttcgcgcgtgctggtcatcacctcgggtgaccaaaccatctggcgttccgactcctgtccggccgacagccgcctgctgctgatggcccagggcgaccacgacgaccagcccctgcgctggaacgctgacgccaccggtgaccagtgccagcccgacgagaacctgccgcgcgtcaaacaggggacatacaaggctcaactggtcctcaaatccaacgacaaaataagctcccagcctgtgccgctcatcgtgcaataagggttgcgcggtaaggcgctcgcggcctgcccttggcctttgtgcaagctttgcgttaaccctgggtcgcttccattccggcaatgtatagttggaatgtcgctggtacgtgcccagggaaaggcgctacggtcggctgtgcaatggttggttcatggggggggcgctcttgccagggagctggaggagaccggggggcgggactccccacagtcagggcggtgtaacgtgcgaggtaaacgggttggaataaggctgttggcgggcatggtcagcgccgctgtggccctgctgctggcctggcctgcgtatgcaagcaccacagtctccatgtacgacagcgcgaacgacgatttcgtggccggcgccacacccgtcaccggcaaacgcccaaagctcaccctgaccaagcgcctgacccagatggatgcgcacaaggcgaccggatccagccaggatgcggggaaagcggtcatggcacccggcatcggcgtcgtcttcaagctgaccgaggtcactcctggtcctggtggcgtcgctggcatgaggcccgaccagaataggtcttacaccagaacgagcaatgtctgcacgggtacgacggacgcgaaaggccgcatcgcggtgggcggaggcaccggctcaggtgtctggatcagaaacgggatacctgctgaattccccgggggcgtgcactattacctcttggaggagacgagttcgccttacgacgacggtagcccgtcggggtacgcgaagaccgaggccagcatcctcgacctgccctaccgggccaccaacacgactcgaacgatggacggctcaggccaggtgacctccacctcaaacgaagagggcttcgtctaccatttgcacctgttccccaagaacaagacagagcaacagctcaccaaaagggcggttggggtcatggattccgccggtcacaatcgctccgacctggtggcccaggtcggcgacaccatcacctgggagatcacccagcgtttctacgacggcaacactggtagccatcctaaccaggacggcaggctcgacttgcaggagatgctctcctgcccgacgccgaacctctccgcccccgacgagtgctatgaaatggaagaccgcctgccctcctcgcttcaataccagacgggctcatcgcaggtggtaggaagctgggaggatgagaatggcgctctgaactcgacacggatggacacaaccgccaatggttctttacgcctgccgctcaaccctctcgggtcagggaactccgacggagtaacccatgtggcggcggggcgctgcccgggtccgcaggggaacgggtccccaccggcgctcatgttcgactcctggtcctcggggaccactttcctctactacaagtggggcggaccggacttgtcacaggttttccagccgagccagcccgtcagtcaccgcaacatgaagatgaccatcacctacaagacgaaagtgactggggtaggggattccgaggcttcgccagcgggtttaatcctcaatgctgtgcacgcggaccacatcgacaacgtcaccaagccaacgccgatcgccgcctccgcggaggtggccaccgctggcctgcaattcgcgaaaaccaaccgccaggtggacaaaggcctggtcggtgccgtcttccgcttgaccaagcccgacgacggtgccggtttcctctactccgatggcaagttctacaaggaaagcgatcctaagccagaaggcgtgagcgtcatcgaagccactgccaacaagatcagcgaagagcagagccttcttaccggccactacgccaagtatcagccgaaagggcaaggaatcgtcaccttcgccggactgcccatccttggggaggacggtagagtcacgacggagaacagccggctcaagttcggtctggtcgaatatcgggcggggaaggagcacgagttgagcaactcctcgttatccttcaatccgagcagcaatccatacaataacgctcccagctaccagttcgccaggaagaccttcatcacggtcgacttttccgcctactccggcgaaagctttgaggagatcgtgcaagctcgtcatggcatggccggtgatgtacccacgaacctcttcggggactatcaggcggatcgcgcaaaggtgtcggcaaagttcgaaaacgctgagggaaagaacctgaccctgggcatcgtcaactggaagtcagacgaaaaagaccccacccaagtgggggcgctgcctctgaccggcggtgtgggcatagggctgatgctgctcgctggtctcgcgttgatgacgctgattggctaccaaatccataggcgattcatttcagaccccctgccccccggccaccatcgcgccgcatgattcgccttgcggtcatccggacccaggcgcggaactgagcgcttggcgcttgcgctcccgccgctggtggccgctcaccgccaggcgagaacctggcggtgagcgggtcgagggccaggagggcgcgccgcccaggggacgggtgctcagattgtgatgggctggcttgaaccgctcggatggagagggcccgacataccttgttcgccccttgcgaactcggcaggaccgtgatacagtagattctttgtatgaggtgtgtcatatagcgggcatgcgtcatcgaggaggcgcccgcgaatcggcatatagcggctatccggcgttctccgtggggtatggcaagcattatcgaatacggcgaacgataaggaaagtccattttggctgcacctaaagctgcaaacagtagtatgaaagttcaagcgcgcgccgacgcagaggccattaagctgcacaaggcctccgaccgcgtcaacttcggctcgatcaaagagcccatcgacgtcccctacctgctgggcgtccagaccgacagcttcgactggctgatcggcaacgagcgctggaagcggcgcgtggaggaggacgaagccgctggcacgcacgtggtgccccacgtgtccggtcttgacgaggtcttccaggagatctccccgatcgagaacttcgcccagaccatgagcctggccttctccgacccctacttcgaggagccgcgccacacggtgcaggagtgcaaggagaaggactacacctattccgcgcccctgtacgtcaacgctgaattcgagaacggcgacaccggcgagatcaagagccagacggtcttcatgggggacttccccttgcagaccccccacggcaccttcatcatcggcggcaccgagcgtgtgatcgtcacccagctggtgcgctcacccggcgtctacttcgaccgcacgcctgaccgcacttccgacaaggaagtgttcggggccaagatcatccccagccgcggggcctggctggagttcgagatcgacaagcgcgatgtgctcggcgtccgcgtggaccgcaagcgcaagcagtcagccatcgtcttcttgatggccatcggcatgtccaaggccgagatacgcaaggccttcaaggggtacccgctggtgctcgacgccctggagaaggagcccatagagacccaggacgaggccctgaccgacctgtaccgcaagattcgccccgcggacaccgcctcgcctgaggctggcaagaacctgctggagtccttctacttcaacaccaagcgctacgacctggcgcgcgtgggccgctacaagatcaaccgcaagctgggcatggagtccgactacaacgaccgcgccctgcaccctgaggacatcgtcgccacgatcaagtacctggagaccctgcacgacggtgggcagaccttccccggcaagcgcgacggcgaggacgtcgagctgcgtgtggacgtggacgacatcgaccacttcggcaaccgccgcgtgcggcaggtgggcgagttgatccagaaccagctgcgcaccggcctgagccgcatggagcgcgtggtgcgcgaacgcatgacgacccaggacgccgaggcgatcacgccacaatccctgatcaacatccggcctctgaacgccacgatcaaggagttcttcggaacctcccagctctcgcagttcatggaccagaacaacccgctgtcgggagtgaccaacaagcgccgcctgtcggccctgggccctggcggcctctcgcgagaccgcgcctcgatggaagtgcgcgacgtgcacccctcccactacgggcgcatgtgcccgattgagtcccctgagggcccgaacatcggcctgatcggctcgctggcgaccttcgcccgcgtgaaccccttcggattcattgagaccccttaccgcaaggtggtcgacggcaaggtgaccgacgacgtggtctacatgaccgcggaccaggagagcgagcacacgatcgcccaggccaaccaggagctgaccgaggacgggcacttcgtcgaggaccaggccttggtgcgaaacgccgaggcggaggccaccgatgtgccggtcagcgaagttgacctgatggacgtctcgccacggcagatggtctcagtcggcgcctcgctgatccccttcctggagcacgacgaggggcaccgcgccctgatgggcaccaacatgcagcgtcaggccgtgccgctggtcaagtccgagcggcccctggtgggcaccggctccgagtggcgctccgccgtggactcgggcgacgtggtcttggctgacaagccgggtgcggtcacctacgtgtccgccgacatgattcgcgtgatgaacgacgatggcacccagtcctcctaccgcctggccaagttccagcggtcgaaccagaccaactgctacaaccaggtgccgctgatcaaggacggcgagcgcgtggaggccggcacggtgctggctgacggccccgccacccagaagggcgagatggccctgggcaagaacgtgcttgtggccttcatgccctggaacggctacaactacgaggacgctgtgatcatctcccagcggctggtgcgcgatgacaccttgagctccatccacatcgaggagtacgagatcgacgcgcgcgagaccaagctgggcgccgaggagatcacccgcgacctgcctaacgtgggcgaggacgcggtgtccaacctggacgagcgcggcattatccgcatcggcgccgaggtcgaggccggggacatcctggttggcaaggtcacgcccaagggagagaccgagctgacgccggaggagcgcttgctgcgcgccatcttcggcgagaagagccgtgaggtgcgtgacacctccctgcgcgtcccccacggtgagaccggcacggtcatccagatcaaggagatcacccgcgaggaggccgaggaggacggcgacgagctgcctaacggcgtcaaccggatgatccgggtctacgtggcccagcaccgtaagatcacccagggcgacaagctctcgggccgccatggcaacaagggcgtcatctcgcgcatcctgcccgaagaggacatgcccttcctgcccgacggcaccccagtcgacatcatgctcaacccactgggtgtgcctagccgaatgaacctgggccaggtgctggaactccacctgggctggatcgctcacgcaggctgggacatcagcctggacccgaatccggatgccgagtggaagaaattcgtgcccgccggcgccgagaagggcgacccggggactccggtggccactcccgtcttcgacggcgtacgcccagagacgatcatgggcctgctcaagaccaccctgcctgaccgtgacggcgagaagctggtcggcgagaacggcaaggcggtgctctatgacgggcgaaccggcgagcctttccccgagccgatctccgtgggctacatgtacatgctcaagctccaccacctggtggacgacaagatccacgcacgctccaccggaccatactcgatgatcacccagcagcccttgggcggtaaggcccagttcggcggccagcgcttcggtgagatggaggtctgggcgctggaggcttacggcgccgcctacaccctgcacgaaatgatgaccaccaagtccgacgacgtggacggtcgcgtgcgggcttacggggcgatcgtgcgcggcgagaacctgccgccggcaggcatccccgagtcctttaaggtgctgctcaaggagatgcagtccctggccttgaacgtggaggtcctgaacgctgaaggcaacgcgatcgagatgaaggacgaggacgacgacccaggtgagggcagcgagttgggcttcaacatcggcgcccgaccggatgccgccgccaaggccgatcagtcggcgcccgagcctgaattccgctgaacgcgctacgggtcgccggcgccgccccgacgggcgtccggcgacccccgagagtcgtaaagcagcctagggctgcatggatttgaaagacaggacaacatagtgttggacgtcaatgcatttgacaaactgaggatcggactggccaccgccgacgacatccgtggctggagctatggcgaggtcaagaagcctgaaaccatcaactaccgcaccctcaagcctgagaaggacggcttgttcggcgagcagatcttcgggcccacccgcgactgggagtgcgcctgcggcaagtacaagcgcgtgcgtttcaagggcatcgtctgcgagcgctgcggcgtggaagtcactcgctcccgcgtgcgccgcgagcggatgggccacattgagttggccgcccctgtgacccatatctggtacttcaagggcgtgccgagccggctgggctacctgctggacatcgcgcccaaggacctggagaaggtcatctacttcgcggcctacatggtcaccaaggtggatcaggaccagcgccaccaggacctgccggacttgcaggaagagttcgacaacgagatcggccagctggagaagaagcgcgatctggagatcgacaagcgctccaagaagctggaagaggacctggccgagctggaacgctcggacgaggccaagggcgccatgaagacccggttgcgtaacggtgccgagcgcgatatgaccgctatccgcaagcgttacgatgagcagatcgcgcgcatcaccgccgtcttcgaccgctttaaggacctgaggcccggcgacatggagggcgacgtggacctgtggcgggagatggaagatcgctacggcgactacttcgagggttgcatgggcgccgaggccatcaagcagcgcctgaaggacttcgacctggaaggcgccgccaaggagctgcgcgaggagatcgccaccggctccggccagcgcaaggcccgggccctgaagcggctcaaggtcgttaacgccttcctgaccaccggcaacaagcccgaggccatggtcctggacgcgattcccgtgattccgcccgacctgcgtcctatggtgcagttggacggcggccgcttcgccacctccgacctgaacgacctctaccggcgcgtaatcaaccgcaacaaccgactgaagaggctgatcgagctgggcgcgcctgagatcatgctcagcaatgagaagcgcatgctccaggaggctgtggactcgctcttcgacaacggccggcgcggccgcccggtcaccggcgcctccaaccgcccgctcaagtcccttgcggacatgctcaagggcaagcagggccgattccgtcagaacctgctgggtaagcgcgtggattactcgggccgctccgtgatcgtggtcgggccctccctgcgtatgcaccagtgcggcctgcctaagccgatggcgctggagctcttcaagcccttcgtgatcaagcggctggtggacctgaactacgcgcagaacatgaagtccgccaagcgtctggtcgatcgtggcgacgcggccgtgtggggcgtgctggaggaggtcatcgccgagcaccctgtgctgctcaaccgcgcacctaccctgcaccgcctgggcattcaggccttcgagccgatcctggtggagggcaaggccatccacctgccgccgctggcgtgcgcggccttcaacgccgacttcgacggcgaccagatggcagtccacctgccgctgtccgccgaagcccaggccgaggcccgctcgctgatgctggcctccgataacatcctgaagccggccgacggccacaccgtgaccatgccttcgcaggatatgattctgggcctgtactacctgaccactgtgcgcgaaggcgctaagggccaggggcggatcttctcctcgctggccgaggcgcgcatggccctggacttgggcgagatcgacatgcagtccaagatcctgctgcgggtgccctccgacttcatcatacccaagggttgggagccgggcgacctcaaagtcgtggaccccgaacccggcagccccgatgtggtcaaggaggaggtcttcaaggacggctccaggctgttcgcgaccaactatggtcgcgtcttgttcaaccacaccctgcctgtggactacccgttcatcaacgagcaggtggccaaaggcaagctggctggcatcgtcgatgacatcgccacccgctattcgacggcccaggtggccgcgacgctcgacgccctgaaggacctgggcttcacccgggccccgtggtccggcgtgaccatggccttctcggacatcgtcgtgccgcccgaccgcagcaaaatcatcaaggaatacgaggggcaggccgccaaggtcaactcccagtacgacatgggcttgctgaccaacgaggagcgccgacaggagctgatcaacctgtggacagagtgcaccgaccaggtggccgacgccatgcgcgacaacttccatgatgacaacaacgtgaacatcatggtgcagtcgggcgcgcgcggcaactggatgcagattcgtcagatcgcaggcatgcgaggcctggtggccaaccccaagggtgagatcatcccccgaccggtcaagtccaactaccacgacggcctgtccgtgctggagtacttcatctcccagcacggcgcccgcaagggtctggcggatacggcactgcgtacggcggagtcgggctacctgacccgccgcctggtggacgtgtcccaggacgtgatcgtgcgcgaggaagactgcggaaccaagcgtggcttgaccatgaaggtggccgagcgcgacgaggctggcaacctggtcctggtcaaggccgcggacggtgggccttactcccgcctgctggccgaggatgtgctggatcccaaggacggcaagaccgtgctctacaagcgcgacgacccgctgtccatggacaccctgcgcgacctggtcgcccacggcgtggaggaggtcaaggcccgctccgtgctgacctgcgagtccacccgtggcgtgtgcgccaagtgctacggctggtctctggccaccatgcgcttggtcgatgtcggcgaggccgtgggcatcgtggccgcccagtccatcggtgagccgggtacgcagctgaccctgcgttccttccactccggcggcgtcgcttcggcctccgatattacccagggtctgccccgtgtgaccgagctcttcgaggcccgcactcctaagggcgaagccccgatcgcggagttccccggaaccgtcaaggtggaggacaccgatcgcggccgccaggtgacgctgagtccggacgatggcacgatcgagccgctgacttacccggtgacccggcgcgcgcccatgctggtcaaggatgggcagcacgtcgacgctggcacccagctgatcgaaggctcggtcgatccgaagaagatcctgcggatcctcggccctcgcgccgcccaggtgaacatcgtcaacgaggtgcacaccgtctaccgctcccagggcgtggacatccacgacaagcacatcgaggtcatcgtccaccagatgctgcggcgggtgaccgtcatcgactccggtgacaccgacctgctgcccggcgagctggccgatcaggccaagttcaaggccgccaacgtgaaggccgtcaaggctgggggcaagcctgcagcgggccgccccgagctgatgggcatcaccaaggcctccctggccaccgactcttggctgtcggccgcctccttccaggagacgacccgcgtgctcaccgaggccgccctgaaccagaaggtcgacgatctcaaggggctgaaggagaacgtgatcatcggcaagctgatcccggccggcaccggcttggcgcgttaccgaaacgccaaggtggagccggacaaggccatccgtgacaccatctaccccaacttcgggctgggcggcgactcgacgggcgacctgtccgatgctgacctggctgatgtggacttctccaacatcgacttcggcgacctgaagctgggcgacgatttcaacccggatgatttcctgaacgaccaaggcgggcagagcagcctggacgaggacggcgacctgccaaccaacgcccagaccgccgccgaggctgaggctgacaaggccgaccaggatcaaacaaccgccaagggcagcaacgatctgggcttcaccgatgcccaaggcgaccaagcctccaacgatcaggaaggcaaggggtccggctccggcagcggaaccaccaaggcctctttctcttcggctgacaagtgatagcggtcgcaggtagataagttcgggcccgcacctggcgcgcagacgctgggtacgggcccgaactgcgtgttggccccgtcgcggcggctcttgtgtgtttcagtggtctccagacgcgcaagccccaaggcagggggatgaggcgccaggcccagcggcggaagcggcccttggaactcaggagccgtaccgccgcgcgatctacgctctgccagtagagatcggcctcttggggcgagcaatcggctgtgctgaaggccgcttggtcggccagcagagccaacgcattggccgggttggcttccgggcctgacgcccgccctgccgggggacgctcgcctagggcagcatgcagtgatcgatccagcgtttgggcctgctggctgcgggttcttccactgactggaacgcccagccgcctggccagagcgatgaggaaccgccagcctgccaggatgcgctcgcgaggagttccggtcagcttcagcagcctgagagagcgtctgctcgccgctgataaacctgctagcaggccggtgcaaacccataggggcagcgtccatagggccatagccctcagtaggggaccgacccgttcccaccatccctcgtgcttggtcccctgaccgcccgaacccgcgttctgaggattgtccacgcttggcggcccctcgcgcaaggggtcggacaggggaaggggaggtcgggcccggttcggttccttctggcgctccgaccggtcggtctgtgggcgtcggctctgcgggggagtggggtggaaggccacccagcccaacccctccaaatccacctccacccaggcttgcatgtcctcgccggtgaaggtcagagggccgttcggcttgggcgaaggaacgctttgggcttcggcatcgatcgccgcttgcccttgctgggggaggaagcctaagacgacgcgggcgctcaggccctcctgccgggccatcagggccatcagggaagcgtactgctcgctgtcgccgaccagggcgtccgctctgagcatccgctcgattcggtagctgccatggcccgcttgcgaaggataatcaccggctaaaccatgggagaaccagccttcggagcgcagggcgtcggccagattcagcgccttgcgccccgcgcttacgcctggggttgtgccagcgaagcgattggcggcctgggttaggccggcgggcggtcggttcaggggaggctgggtgaccggggcggcgcgcgcgctggcgattgcctggcgggagggaggtcgcgggggcaagtggccctgttcccggtaggagaaagggccggccagtccagcgggggccaaggccgccgcagaagctgcgtcgtagtaagcctggtccagaggtacggcctgtgctcggtcgaagcgctcggcatggccgacgctgggcatcagaccgggccctaaacctgcgtgaacgtggaaggtcgccacaaaaggcggtcccgccgttggctgctcttgctgattatccgcggcgttgggctgctgacggcctaacctgcggtagccgccaccctcggtggaccccgtcccgcccacggtccatacctggccgtcgaaggcgtccaagaccgccagacgaatcggtgcggggctgggcagaccctcgacctccagcagcggctcttggcgaaagtccttcagataagctcggtaggtgctcaggggactggtccgcgtgacgattgaggtagggggctggtagtgctcgcgcaggaccagccgtctgcccggcgcaagcccttggacgctcagggacaagccgcatgcggtcagggcacagaccagtttcgccgcggcacgcctccgaagcgggcggtccgaagaccagaaggccagcgctagggcgagagctaggccggtcgggcctgtatgccagccttccctggtccccaggaaggcgctggccgccattgtggccaaggggactacggctccgcaggcacgggttcgcggccatccatgcacctgggatggcactaaggccaggcggccggccaggtatccggtccacagcaggagggtccacagggccatgccggccccttgggcgcgtcccaggggagggtcttcgcaaatcaagagcttgaagccgctcacggacgccgctaacccctggcctatgaggcttccagtcggcaggaatccccacagatgacgccctggcatggccaggctggggccaaccaatagctgtgccgcaaggagcaaaccgacctgggccagcccaggcagtcggggaagacgcgagcaccaggagcaagcgcccgccaacagacaggccggcaaacccaggatcagccacagtccccaggacccgtagacaggcgccaactggagcgaggccagcagattgcacgcctccagagccgctaactggcaggccaaccgtctagggcgcggattcgtccgactgttgtgggtggagctgggccaatcagcgctgtttggcgaggtcaacgatagctccggctcccattggcctgtaacaggtgaaccacaaccaagaccagtcatgccagtgcctccaacaatgccgggagctgctccaaacagccaatggaagctcggaccttccatccgtcgattgcgctgctgattgccgcgccgccggattgcgcgccgtcagcgtgcgagcccaggttcgcggtcagcagcaggattcgtccgctgactgggtcgcccatgcccaggagcgcccgctggacctgacttgcgacggtgcgggatcctaggacgcagatcgcggcggataggggttgcgagtcagcgagctccgctgaatcatcgcgttggctcagcgccgctggttccaaggggtttccatccggtccgacccagtgcagggcgctgcacccgtccaaccagtcatccgcctcctttggtgtccacacgactgatcctagggtcagccggggggcgcagccgccgcctagggccgccaacccgagcgaggccagaaggctgaccgcaagctcgaattccggtgcgctagcgtaggcgttcggattggcgtccagccagagtcccagcgccgggctttggcggggcaggtagcggcggaccaggagcctgcctgtgcgggcggcggaaggccagtggaccctgcgcaggtcatcgccaggttcgtagtcacgcaagctgtggaagtccacgccctcctcggaccaatcggatcccccttcttggtcggagaggaggccagctccactggctgcctccagcggcacggtgcgggggtggacgaccagtcgtagggggcctgctgcggtcaggcctctggtggacaggccgagggggtcgttccgctggatggtcagggggccgatccaccccattcctcggcgggcggcgcgcagggtcactgtgcgccgcgcgctttgacctggtgccagtcgcggcagtggccatatgtaagaggccgcgcccgctttcaggcgcacttgggctccggtggaacttctgcggcccgtgttgcaggcggaaagggagattgtggtctcctgccctgccagcagggtcagggattcagactcgaatcccgctctcaggtctggggagttgcgggataggaccaggccgatggtcagaagggcgattccggtggcggccatgctcagcagttcggcccaacccaaagccaggaaggccaaggcgctgcccgctgtcagcaagcacacggcccgacccaggggggtcagacggagccagctttccacaggcccgcagtccgtgcgtggctgattctcgcgcgctctcatgcgtccagcccgccctcgggcacaggcacggattgaatgacttcatctattgtttggaagaggtcggcgccgtccatccgggcctgccggttcagtttgatacggtgagccagcaccggctgcgcgagggtcagcaggtcgtcagggataacgtaatcgcgtccgagcgacgcggcccacacctgggccccgcgcaccaaggccagaccggcgcggatggatggcccggtctcgattgacttgctatggctgcaggcctccagaagacgggtgacgtattcgaatatcggggcgctgcagtggacggaggccgcggtggcttgcagcctgttgaagccagcgcggtcaatgattggatccagacgggaggccctgtcccgtagtcgggactgggtcagaatttccaggctggcctcgtggctgggcgggcctaggctgacccgcagcatgaagcggtccagttgggccccgggcaggggataggtgcctagctggccttgagggttctgtgtggcgataaccaggaaggggttgtccatcgcataggtgtgcccgtccacgctcacccggccctcctccatgacctccaaaagcgcggattgtaccttgggcgaggcccggttgatttcgtccgccagcaggacggacgtgaagacggggccggggcggaaggtgaaatccccgctgcgccgctggtagacgctgaccccaagcaagtcggagggcaggaggtcgggggtgaattgaatccgcctgcggtccaggcctagaacctgggccaaggcccgggccaactgggtcttgccggtgcccggctcatcctccaggagcaagtgacccccggcgatcgcggctgtcagacagagccggaccgctttgtctttaccgaccacggcctcgctgatggcggtaaggagtttctcgaaggttcgacggaagtcgtccgtatcggctgggtggatggatggactgcgctcgcggatgcgctggggccggtcagggtccgttccagttcccgcgctcccgcctcggccggtggtgaggttggtgtcgtcgtgggggtggccttcggcgcaggcgctcagaccaggtagcttggtctggtcggacgggttggagcgggcgggtgctagggggatgctggtgtcgtccggcgcccgctgatcggcggctgccccgaacgtggggctcagacgggtggcatcgttcaggtgaccgctgccgggcgaacgggtggcgtcgggcaggggaccgcgggccggcgggcggctggcgtcaggcaagcgcgtggcgtcagtcagacgggtgccgtcgctcggctcggtgatgtccctgagtgagggggtgtcagtgcctgcggccatatcatcgcctgccttccagggtgatcagtgcacgggcggtcggggatgtgttggagggcggctgcccttgggcccgggtcacggcttccaaggtgatggtgttcaggcccggatcgactggcaaattcaggacaccaccaaggctggcgccctcctgcgcgcatggccaggagacggtcatcgcccgcgctccttgactggccgtcagatccacggcctggcaggccccgccatgcagacgcccagccttgagcgtgacttggacccttccgggcggccagccgggctgatcgtggaggacctgttcgaagacgggcgcgtctggacttgaccagctggctccgaccgctgtagccgcaggcccggagcccgcttgattactggcgttgacgctgatggtgcaggttgatcccgcggcgtcatggggcacagccaggaccgcctgagtggatgagggtgaccgacccatgattggcccacaacccgggccggaagcgttgacctggtaactggtgatcctgctgccccggttgcgcgcaggacgccaggagacgcgcagctcctcttgcgcgctgccgtccacgatcaggccttccggggcttgcggcctagcgtccggccgggctgccagcggggccgagggattcgaccaaccttgggcattgcgggcgcgcaccatgaaggagtaagtttgagcgttgaccagaccgccgagtgtgcaggagttggcttgaccgcaagagtgggagcctgagccggccgggctctgataggtcacctggtattcgaggatgggtgaccccatagcggccccaggaatccaagccagcgaaacggagccgtccccaaccacaaggctcgaagcgagcaaggagggtgggcgaggacgattgatgaagtccactattatgctggcggtcacccgccgttcgggcgctccggtcccatcggagaccgtcagtataacccgtccgttggcggcttcgacggggtcgctggcgttgagctcgacccacccaccggtttggatgcgggcggtcaaaccaggctggtcgctggtcgctgcggctagtgagagggggcggtcaggcaaggggttgtatgccccgtcgagcgcgttcaaccgtatgccatggccggcggccaggctgatccggcggtcgggcactgatgccaaaggcttacggctggccacgattcgcagggtcagggccgtctccaacttgccgcctgggtagcggatagtgaacggcagccttacccgctgccccagggcggcattccgactggccgagaaggtcaggtcgccgtccggacgcagcctggcctggattggccctttgaaaccgggactgtcgtaaatcagcgccttggcctgggcctgtgaggtggtgcgcgtcagctttttgagcgccaggtgctgggtctggccgcccgcctccaggtcgatcagtggcgaggtgaacgtcggcggcgcgccgtgctcgccgttgacctcgatcgggagggtgagcacggcttggctgcctacggctgaggacgggccttgggctgcggcggtgaaggtgattgaggcggggcccgagtaaccgtgagcgggggtgaaacgcaggtggtccgggtccaggtaggggtctgacccatccgacttggtggcttgcacggacttgggggaaacgacccgtacaggggctgagcccgcctgcgcgtaagcggagacggcgatggtcaggctggagccggctgctacggtcaagggcggggcgtgagggttggggctgggcctgagcgagccgacggcggggaggcgaatcagggcgatggaggagacgttgtagcgggtgttggtcactgtgtatgggatggcgcgcgcgctcggggaggggttggctgtgagcgtccaggaaccggaggactcccgcaggttggcttgatcctgggcttgggggcctagactcagcgtcaggtcgctgttgggtccggagggattggcgatcagagcgtccatgctgcgcgcgaacctccctccctcccagtccgccgatgtcagcgagcagtcgcgcgcctggggcggtaggatcggggcgtccgggctggtggagacccgcaggctggcctggtcggccattccagcggcattgcgcacggtgtaggtcagataggattcgccggtctgactggggctggtcagatggataccgccctgccgggcgctggctcgtaagggaccggctccctccagctgggggtccagcctggcttccagcccgtccgagctcacgtcgttgccggtcacgggcacgtcggtttggacgcctggccgcagtcggacgtggtcgtctcgggccatcaatcctggcgcctggtcgctgggggcgatgccgacccgtatgcgcgcctgtgcgggctgtccggtccagtcttcgacctggtaggtgaactcgtcggtcccacgagagtccgggtaggcctcgtagagcaaggatctgtcgctggagcccaagacgcggccccgccggggcagctgcgagcccaggcccacaagcgcggtgtcatcgccgtcctggtcgatgccggtcaggggtatcggtatgcgcacttgaccgccggccacggtgcgggcctccaggtcacggggcctgctgggcgccttgccttcggcgcggctggggtggatgtctatggtgatgctccccctggcggagccgccgccaggctcgctgaccgtgtaagtcagccgggctcggccagcctggtcgccggccaggtaccgcacgctttcgccgctgacgaaagcttggccgggcgggttgcctgcatcggcctccagtttgggcgacaggctgacttgcgcgcccgtgggcgagctcacgtggtccatgacggcgatggtcaggctccctccctgacgcacctgggcctggatgtcgctggccctgagggcgggctgggccgactgccgcgcggcgggtagaatcgtgatgctcgcctgactggagccggcttggttggccgcctggtagcgaatcgtcaccgggccggtcaggctacgcttggcctccagtctgacccaccggccctcggccacgcccgccttgattccgctggcgtcgctggtatcgaccccggtcaagatcaagggccctcccgtggggtcgaagtcattggccagggggtccaggctggcctgaccggtttgatccaggaccgctgtgtcgtcggcagtgatggccgtggcgcctttgcttgaggcctctatggcttgcaggcggatgagcccttgggacttgcgcccagcttggctgacggtgtagggcaggtagtagtcgccaggtcgctcggcccgtgcgcgcacggtcagggagccgggcaggggattggtctcgacgccgggacagtgctggatatcgtcgagttgcaacggcgagttcgggtcggcttggacggcgggggacaggttgatctcgcttgtctgaccggccacgagccggaggaccaggggaccggccactggggcttggctacccgtggcagagacttggcaatcgatgagggcgctgctcgtcgcacgcccatccgaaacctgaacctccaagctggccggcccggcggcgtcgttggccgcatgcacgtccagtcggccgtcggcccggacggtcgcggtcaggggggaggcaggccgggtttggaccgcgagcagggccaaggggtcgccgtccgggtccgtgaaccctgccaaggcgttcaggctggtccctgatccttccgctatccggcagtcgggcgacgggccggtccaggcgggcggacggttgtcggaccggggcaaaacctggagcgcgatggaggccgatgaggagtggccccgtccgtcgctggccgtgtaagagacgcgcacactgccaggtggcaaatccgaggcgtccacttgcaggaagcggcccccgccggcaggctcggcccgcaggcgctggtcgctggccgtggcgcggctgatcgaggccagcgcgcagccggtctcctggtcgttggctaaagggtccaagagggcccgggagcctgcgcgcacggctaggtggtcgtcctcggccctgattgagccttcctgcgccttgcaggatgcgctgaagtccgttgggtcggcatctttctggcgacctgtttggtggacctcggccgccttagggtcggctgggtcccagctcaggttgactgcctgggcggcggtgtcagggtcccagaccgagcctgattcgatgtcgttgagcaccacttggcgcttattggcgcggaacatcagccgtgtgccgggcgtgatcgaatccaggctgcgaatgggcccatccccaggcttgctaggggcggatggccggcccccgtcggtcccgcataaacgggtgaaattgcgggcttggctggaccacgccgcccacaggcagcctcctgaggagaccggcctggcgggccgcccggtggaaccggtggcgatggtttccaagcttccgtccgcttgatccaagtccgcgatgaacacatgcccctggtcggtggcggcgatccaagagcctttctggtcctggtcaacgggagaggactggagctcgagcggcccttgaccgggcagctggacgctgccgttcttccagcgcatggtgcggccggagagtacgaccgcctgtccttggacgacggctagggcgtccgcgctcagcctccgtccgccagtcagggaggggccctggtggatcgtgcgggcggcggggttgctcaaggtcagtacggcgccgtcgtcagcccggtacccatagagcgtgccgtccgcccctatggccgcttggcctccccggcccagggccatgaccgggtccgcgtgcgccaggtcggggggagggaaggaggcgcttcctgcccaaacctgaccggttcgttggtcgaaggctgcgagggtgcccgcggacaggagtggcttgacgctggctggggcatcggtagagccggacgttttgaggctcaccgggtcgattgtggataggcgtcgtccctgtcgcagaaaggtgcgtccgccgctctgggccaggtccaggctgggggagggagcgggcagcatggcgtcggcctcgcggatgcgggggttgaaacgggccagtttgcctttgctggccgaagccacccagaccgtgccgtcgtccaagtccgcctgctgccgattgctgaccggcaccaggatgaccgccgtggccagggcagcagccaggaggagggccaaggctgaccggaggcgaagagccgtgcgggggtcgcccttggattttccccaggacgggttttgccgccagcggcggtccttagtggggcggggtcgtatcgtcgcccatccatatgcgtcagtcatggggccaggctaggccgctcagggcgcagaagcgcctgtggacagcccatgtggtcgaatgtgcgtgcttgtggtcgaatgtgcgcgagccgcgtcggttcgagcggtgcctaggcgctcaggggagggtggcgcagatgcgagctggctggttggagatgcgttggtcggcgcgtaaaagggccacttggatgcagacggcccgttcctgccccgcattgacctgggtcttgggctcgctgctgcgctcggccccgcgccaatcggcctggccgtcctcgggggcggtggcgggcacagtcttccacaggtaagcgtcgccgggctctggagccgggttcgaccaggagaaaagcgccaggccctcatgcagatcccctcgtcccgcagtcaccgtgggcacgctggcaggggcggattggccgatctgatccccgctggacccggtggaggagggcaaggaagaagaggcgctgaacccggcattgccggtccctgcggccccgcctgcttcgccagcccgtttggccgccaggaagccaacgcccaaggacaggaccgcagccaggaggcaagccagggcgaagacggctgcccggcgcagcccccatgcctgctgaccgctgatcgggtggccggaagcgcttgacggtcctcgagcatgcgctggttgggccctcagactccgcaaccagcccagttcggaacgctcgctccccttccccttgacacggtttgcctctggggcggctggtcgcgagccacccagcgcatccaggcggccggccgaccccgtccgagcgcttactggccttcgggcgttcgtggaagtcgcgattcgtccgccagacggcttccgcacgacccgcgcggcggtggcgggagcctggtcctcgtcgaaggcccgagcgtccgcttgattcccatcggattcacccttgctcgcgtcgctccgtccatccgattgcttgaacccggagccatccgcgtagccgatccgcgcgcgctcgccgctttcaccgccttctgctgaatccaagtcctcggaatcagcgctgccaagatccgtgttcccgtcgccagccccagtcgtcgccagcgtcgcgtccctcttttgctttctcgcactgaggcgccccgccatgcccagctcctcttgactggggtaggggtccgccccccgcgcgaccagaggcgtcatatggccgtagagccgggcctggagcacctgcatgtcgcggccgaaatccagggaggagaagtagcgttcctcgcggtcgtgggccatggccttgtcaagcacccgctcgaagtccggcgaagcctcgccccgccgtagcctgggcggtccctcatgctcgatgagctgggcgagctcctgctcatcgcgtacccggaaaccatactcgtagggagattttcccgtgagcaggccgaagatggaggcgcccagggagtagatgtccgaagcctcggagcctccggacttgtgggctatgatttcgggagcggcccagggcacggacagccctttggcttgggaggccgtgtaggtggaggccgagatgccgaaatcggacaggaccggcaggccgcgcgtggtgaccaggaagttgccaggcttcacgtcgcggtggatgatgccctgctgatgggcggcgtagagggcggaggcgatgcgcacgccgaggtccagggcgccgcgctcgtccaggcgggtggttttcatgatccgcttgtagttgccgccgggcgcgtactccatcacgatatagtcgcgcccgtcatggctgacgccggctgagaggatggtcaggatggccgggtgggccgacaggcgcgccatgaacgttgcctctttgaggaagagggcgtgcgaccggtctgaggcccgccgcttgcttaccttgactgccaccagccgtcggggctccagctgccggtaaaggtagacccagcaggtgcccccctggcccaggggccgcaggtagaggtaaccgctgatttgcggggcgccctcgacggcggactcggtgtcctcagggtccgccatcctcccacctcctcccacaggccgtttatccaggtaattctatgcgcacggggggagcggcccgcgcgtccctggcccggttgggttccgggggctcgggcgcggttggtgtacagtggctcaaaacccatcgcgcccaacgcgtcccaccatccagagaagggacctacggggcgaacgagtgaagacaaggcggaatcaatggacaacatcacgcgaattgacggactctacaacttccgggacttgggaggcatggagacggacagcggccacatagcctcaggacttctttaccggtccgaggccttggccgggatgagcgagcagggccgcaggcagttggaggactcaccggtggctctggacctggacttgcgctccgaccaggaggccagattgctgcccgaccccgagatcaagggcgttgagcgcgttcacatcgagatgctggacggagccatgcccgaggacgcgggcgacatcgagcggcgtgagagccagggcaaggatgcggccgctttgcttcggcagacctacctgtcgctgatcgcccacaacggcccggactacgcccgggtggttcatcgcacagcccaggccgcggcggccggcaaaggcaccctgatccactgctcggcaggcaaggaccgcaccggcacgtcaatcgcgttcatcctgaccctggctggcgctcgaagggagcaagtcgtggctgattacgcctcctcgcaagccaacctgagtggcgcctggcaggagtccatgctggccatgatcgagcgggctggcgtgaatgtgccggagagcatccgcccgacgatggtaatcacgccaccggccctgattgaggagatactggacaaagtcgagcgtgaatacgggtccgtggccgcctacctcctggctaacggcggccaccaggaggacatcgacgccctccggcaggctctacgggccgactgacctaccgggcccaccgcccattgaacgctgggacggctccggacttgatcgcccgaggcgtagcgggccggaccagggtggaccttaggctggagacatgacgagagcgaagcaggtggacatgggccaagcgctccaggccgtggaacggctgatcgccggcgacctcaacggcgaggacggcctgtccagcacggtcctgtgcctggctggcccgccccgctccggcaagaccacgttcgcccaggagaccctgttggccgccctggccgcctatggggacgggggagcggtgatggtggtctcgggccgccacgccgccgaccaaatcagcaaggccgtgatcgcgcgtcggggcgcatcctcccagagccgtccggtcggcaccctccaggcgctcgccttccgcttgctcagccaatcttccgccagccaggagggtcgggcgctgcccaagctcttgaacggcgccgagcaggacgctctcctgcggcaagtgatggcccgtcacatagcgcacgtggaagccggcgacgactgcccctcctgccggttgcttgagcgctacttctccagccaagcgggtttaaacggggccagaggctggtctggggtgctgacccaggcgacggttagggcggatgacttagccgggcggattgacgatgacttcatcgcccagctgcgagacatgctggcacgcacaatcgagctgggggtcggccctagcgaccaggggccgattctggatgcgctgtccagccaggcgctggacctggacgagcgtgaccggctcggcgtccagtggcgtctggcgttcgccctggggcaggagtacatggaacaggtggatgccgcttatcccgaccagtaccgtttggacccttccatgctcctggtgtccgctcggcgggcggtggaggaggatgagggtcttgggttgccggccctggtggtcgtggatgactggcaggacctgaccatggcgggcatgggattcatccaggccctggtccagcggggggtgcgcctggtcctggccggtgactgcgacgaatcggtccagagcttccgcggctcctacccggagttcttggacgcgcgggtcggcagccggccggtttccctagccggttcgggagcggggaacggcccggcacaagccttgttggaccccgacctggggcgcctgggcgcggtccgcttgtccctgccttaccggccgatcacccttccggaacacagccccagcgaggccgagggggtcaaggcggacggcccggcctcgtacgcggacctgctggccgcccgcgtcagcctgagcatcctaagtgaagaaggcggcgatacaggcctgcccgaccgccccggcaagatgcccgcctggccgggcgccggacccatcggcccgttggacccggacagcccgctgctggccgatggcacggtcgtcacccgcctcctgcgtacgccggatgaggaggaggacgatgtcgtctggcagatcaagcacgagtacttgtccggtcattgggactggaacgacatggccgtcatcgcccacgacaacgccactgtgcgctcgctgggggccaagctgcgcgccgagggcgttccggtgcgctactcctcgatcgccaggcccctgaaggatgagccaacggtgcagggtctcttcgccctgatcgagctcgcccaggctcaggccggaacggtgcccggctggcaggacttgtccgccactgatcaagcctcctgggtgggtcaacgcctgcgcaggctcctggccagcccgcttctgtcggcgccgctgccagggggccagagcccgcgcccggtccgggtggagcgggtcgatgccctcctctccgtcctttcctgcctgacccggatcgggcccgaccagcagacgtcgtctggggccgctgagataaccgctgccggcggggccgccttggccgccgaggcaacaaatcccgctaaatcccaggactcgccggaggctccgggcgcggccgctggcaccgggcaaagtcggccggtcgctgccctgagcctattggcccaggtctggcgctcctacgccagtggcagggagcgggaaatcgccgcggccgaggaggccagcggcatcagtgtggacgactccctgatggggggtgcgtcagcacccagcgtgggggcgggtcctggtcagagcggcttccttgtggatgccgacgcgattggcctcctgctcctgcttgactccgcgattgacggccaggcttccggtgatgccgcaggccaagccccagcggaaggcgcccctgatgcgcacggcgattcggggcccgaaagcctgcgccaatcggtcctggaagctctggccgccatagccgacccccggcgctcggatcccgacctgaaggccctggcccacgccctggacctggccgaccgcaccgcgcgcgacctggccgccctggacgatccggcccccgaatacgcgctctggcaggcctggagcgcagttggcgtcgctgacgactggcaggcccaggccctcgccgcctcccaggaaggagaggaggcgaacgaccgcttggatgccatgatgcggctcttccagttcgcctcctcttcgcaagagattgacaatatcaacgattttttggcccaggtgaaagacatgcagatcgaggcggactccctggcctgcgtggggccggtcgaacatgcggtccgcttaaccacgccggccggcgccgcggccctggccacctcctggccggtggtctggctgcccgccctccaagagggggtctggcccaacttggccccgcgcgacaccctcttcggcggagaagacctggctgacctgatcctgcacgactccatccgaagcgcgaaaaccgacgccggcggccacgacccccggctcagggccaccctctacacggaggagaaggggctgttggcggcgatcagccgggcgcgcacacaggtgcggttctccgcggtctggaatgaccagaacgtcccctcagccttcctctacggtttcctgcccgagcgctatccccgcctgtccgacccgagccaagccgacttctccccggtgggaggcgaagcagacgcttccaccggcttatctggactggaagtggggccgcgaggcctggtggccgtggcccggtccatcctgtcccgccaggctttgggcgcgcccatcagcgagcaagatcccctggcccgcgacgctgcggcggccctgcgtctgttggccgagcatggtctgcacgaggccgaccccgcctcttggcctttcctgtatgcgcggacgagaccggtcgccggaccgccctccgacccaagcgccgccccaggcgtttccttcgctgagccttcgtctgctgggccttcggccggcgggctcccatctgatggaccttcatcgactggaggcgcatccgccgaggcggctgggcctggtggtggctccagccgcgtgacgctttccccctcggcagtggaccggatctgggcctgcccgctggagtgggttctggacgatcgcgtctcgggacctcgcccgggatcggtggccatgagcttcggcagcctgatccaccaggtggcccaggaagccgctgatcagggcttggaccaacccgagcggggcgatttgggcgtggacgcggtttcagatgctgagttgattaaccgcacccaggggcaaatgatggatatttaccatgaattgtcccggagcctgcccgcctatccgagccccaaggactcctacgacgcccgccggcgcgacagccatgcacagggcatcctcacgaacatcgccagctacttcgttatgagcgccaaggaagggtacgcgcaggaaggcaaggcgggcgtgccggtgggggtcctgacatcctccagccaggaacaggacttccgggcctccttccggccggtcgatttcgcgccggtctggaacgccaccttccaggactgcgcactgggcggcgatgagttcttcgccctggcctcggctctggtgggaggtttcccccaggctttgaaagcggacagcctgattacgctgaccggccggatcgaccgcctggagcgccgatccattgagggagaggagcacttgcgcctggtggactacaaaaccggccgctcctctcacaacgccaagcagattttcaacgacctccaactggtctgctaccagctgggcctggcctaccaggagggtgagagcggcgtcggccggcctcaggcgccgaccgtggcgccagtcagtcaggccgtgctcttcgatgtgtccaccagtccggttcccgcgccttttttcaagaatcccgaggccgcctaccaacccgccctcttcaagcaagggggcttcaacaacatgttcgcgcagcgccccaggctttcgaaactggaagccctggccgacatgcaccccttgccccagcaggcgcctgaaggtgtgagccggcccacctgggacttcgtgcgccaacgctcgggcagccaggggctttgggccctgactatggtcagccgggtcctgttcgcggccggcgtcaagctctcctcgggcttgcaggatgcggttttcgacgctgaccgctgccataacagccgcaagcagaacgagtcttgccccgcctggcaggctttggcgggctcagtgatggaggacaggcgatgaaccgcacccgcgagcaggatgagatcatcgacgcccccgaggatcaggacctgctggtcatcgccggggcgggttcgggtaagacgaccaccatgaccggccgcatcgtctcgctgattgagcgggatgtgccccccgagtccatcttgggcctcacgtttaccaacaaggcggcctcggagttgctctcgcgggtctcgatggccgtggcgggccaggtcggcgagggcggacggggaggcctggacccggacaaggccttcctgaagccggatgtgcgcacctacgacgctttcttccagtcgatagtgcgccagtacgggcttctggtgggtatggaccaaggaacccagccgctctccgatgctggcgccttccagctggccgcgcgcgtggttcaggagcacctcgacttgattttcccgagccgggccgaggacgtggagcaagccttggattccgcccagtcggaggccgaggatagggatgaggacgggctgggcgccttcgaccgagcggtcaagcaggtgctggccctgacccagtcctgctccaccgccatgatcagccggcagtgccccagcttccaggaggcggtggaccgggtgcgcgcttgggaccaggccttcatcgcccggattgacgatttgattggctcccagcgtgtgatcgaagcctccatagcgggcaaggccgcggtcagggtgcccaagtggacgaagaaggacacgccggagacctaccaggacaagatcgcgcgcatgcgggaggcacggggccaggagcgggtcttccaggcggcggcccttcggcgggccgccctcgaacgcgagcgcctgctgaccctggccgagggctaccaggaagccaaacgccaagcggggatggccgagttcagcgacttcaccttggccgccttccagctggtgacgcgcttccccgcgatcggcgccatctaccggcggcgctacacccacgttttcctggacgaataccaggacacgtccactacccaggccctgctcttggccgctcttttccacccctcccaggacttggaggacggggaaggccctcagggggattcaggggatgatcagcctccagcggggccccaacgctcggcggtcaccgctgtgggcgaccccttccaatcgatttacgcctggcggggagccagcccgggcgctttcaggaccttccagcgcgagttcggcatggaggcggcggacccgacccctggtgacctggccagcgctggcgtctacggtcatcaagcccagcgtccattgtccctgtcgcgcaccttccgcaacgcccgggtcatcctggagtccgctaaccgcctgaccgagcctttgcgcattgacgtggccggccagcccgcttccagcgcccgcttgcgcgaggtggacgtggagtccttgcaggctcgcgatggggcggacgcaggcagcctgggcctggtgggctacatgagcctggggcaggaggtcgacggtgtggtgcgcttcgtgcgcgaggccaaggcccgctacgccaagccagacaagtccggcgtcgacgattcggccccgcacgtggcggtcctcttccgctccaagaccaacctgcccgcctaccgcagcgccttggaggaggcggggttgagcgtgcaggtggtcggctattcggccttgttcgaccgccctgaatcgagggacttgctggccctcctgcgcgtgctttgcgaccacactgattccgcttcccttctgcgcctgttggcttcgccccgtttcaacatgaccgtcggggacttgtccgccctggccgatttgactggccagctgaatacggagagcctttaccaggccttggttcaggcgggccgggcaccggagggcctgcggggcgccaagatgagcgcagcggtacggggccagcgcgacctcctgcctgccggggtcttcctgactgacctgctcctgcgagacgacctgcctgccctgctggcttcccgccgggccgccaggatcagtgaacggggccgctacctgctgctccaggccgccgacgtgctgcgggaggcccaggctcgaaccggagcccccctgcggcaggcggtcctagccgcctcccgcgcgcttggcctggacgttgacctggtggtctcacaagccttggccactcctgaggctccaatcgacgcttcagcggccaagtccggcttgagcgcccttttcgaccaggtggacgcctactgccaggagctgccggaccggctgagccctaccttggcgggtttcgtcgcttggatcgacgccatgcgcaccagtcctggcgagcctgcgtcaggggcggaccgtcatgcggacgtggtcctcatgaccatccaccaggccaagggcctggaatgggacgcggtagctgtggtcggcatgaggaaggaggccttccccagcaaccagggcgaccggttgaaggtcaaaccgctggccgactgggagggcgagaacctgccaatggcttacgagtccactgcgcaaacctggctgaatgacccgaccgcggtgccggcgccggtgagggcggatgccgcgatcctgcccagcttcccccactgggccgaacctggggaggcccccgagcaggccttggccgctttggacttgaccagtctggaagacgaggcggtaggcggacttcgggccaataccggcttcgctgatgacgaccaggctccgctgccgcaaggacccgggcaggacgcccctgatgcccctcagcccgcctgcctgtcccagagcgaggagtacggccgccgcctgcatgacgacgagcgccgcctggcctacgtggccctgacccgcgcccgccacgacctcctgctcaccttcagcgccaagcccgcggaccccgagcgggccctgctgacggcggtgcctcaaccaggtgaggagggtcaggatggccaaggggagaaaaccagcggtggccccggcaggcgtaaaccgcctaaggaccctcaagagcagatgctggaggcggcttctaacttctggctggaattaaacgccggtctggctgaccaacctggtctggcacccggcgcctcctggctggcggggcagggtgaggctgggcgagtcggtagcggcacccactcgtccgcccccgccatgcccgtcaagggcgagcgcctgatgcccctgggccgtttcgttggcgaccacgccgtcgagtacgagcgcgcggtggtgggccaggccttggcagaagcgcctgatttggctggccgccaggggcaggggcagggttcgatatggccggtggggctgagcccgcgcatcggtcaggccctggccgaatcggccgccttcgtggcccggaccggtacttcgcggacgggtgagcaagccgccggaggacccggggcgccagtcgagggcctgctgactgacggctcctcgctctacgcgcacgccgtacgtctgctcaaggccggcagcgggcgcttgggcgttgccggcgacctgttggtccgtgacgaccaggccctgcgacgggtgggctccgaggtaaccggccagcgggtcgaatcggtcacctcaatccaggctcgctccggcgctctggacgagcggtccgagcgtcgctactggcgctccgtggtccgccccgtcccgcaggtggactccccgctggcgcaggccggcaccgccttccatgcctgggccgcttccttcctgctgccggacgccctgcctgaccctggggccgtcgatgccctccccggtggccaagccattgacccctacgcggatttggactctggggctcggcccggcgaacaagcggggattgacaccccaaccgccgccgggggagcgggcgctgccctgtcagacgaccagctggccgaacgtcgtcggctcctggcccaattggcggacaaggaggccgccctcgaattctcagaccagccgctgccgtccaaacaggccgaccgccaggccaacctgctggtttgggagcgtcgcctcgccgattccccctgggcccaccgtcgcccgcactgggtggagaggccaatcgtggccctgatcgccggacgggtggtcaaaggcaaactggatgcggtcttcgacggtggcctggaggccgccgacggttccaagcgcttcacgatcgtggattggaagacagggcaccgcccccgcaacgccgatgagcgccgcctgaaactggagcagctggacctttaccggctcctgttttctcgcttggaggacatgcctttggactctatcgatgcttgtctttactatataagcgaggccgatccctcggtgcgcacgatagtggcggaccctaaaggcgagcgcgagattgaagaccaggtgcgctccgggctgcccgagcagtccgacgacgactgagccctccagacgggaccgggcggcagcggtgagagggactgcggcgtttaccgccagacaagagccccaagtaagcaagacacgagccacacaaggctgcataaagcaggacacaggtgcgacagcaaatgagacagaccttagagcaagagtcaggaatccaacggtccccgaagactggggctgtgagcctacgcgatatgacgtgggaggatttggatcaggtggccgacgagttcgagcgaacctggagccaggccgacagtgatggcgaatccctctcccgactggaatcccgtcacttcgtcctgcgctacctgctgaccacgagccgggcgcgcgtggcctgcctggacggccggttcatgggcgtcaccttgctgggcttggccggtcagcccatcctcttcccccaggctccagcccagctgacccaggccgacgccgccttgtccgccagcgatcagggcgctcggaccttggaacgcatgcaagcctggcaccgcttggaggaaagggtggaggattcgatcgaggtgcgttccagcgcccaggccgaactcaagctcttccttgtggccgcccaggcccgcggccacggggtggggggcctgctctggcgcgacatgctcgcctacctgggacaggccggggtgaagcgctttttcctgcacacggattcctcctgcgatgtgtcttactacgaccatatcggcatggagcgcgcggccgcacgctggagcgcggaccatcccgaggagacggacgagcgcagcggattctacgaggacattttcgtctacgcggcttcggtggctgaccagcaagcccggtggggtttgcgcaaccagggcggcggtgggtccaaatgagcgctaagacccgcggatcctcaccctacctgacccttttccgcttgcctggagccaaggggttctgcacggcggccgccctggcccgcatgcccatatcgatgatgggcctaggcattgtgctggccctgaaccacatttataacaactggacctcggccgggcttatgagcgcggtcttcacgctctccgccgccctggtcacccccttctacgcccgcctgttcgaccgcttcggccagcggcgggtgggcctggtcgtactgagcgtgcagatcgtggccatgctggccttcgccctgggcgcactcaaccgcatagcgctgggggccctgttcgtcatggccatagtgatgggtctgacccagttctccttcggcgccttggtccgcacccgctgggcttgggccctggggccgcagggggagcggggcgaggaactgctcaacaccgcctacgccctggagtccggcgtggacgagtgtgtgttcatcctggggccgatcctggcggcctggctggccacctccgtcaatccggtggcccagctgttcgtgccgatcgccgccctgctggtgggtggcctcatcttcttctccctgcgttccaccgaaccgccggcggtcacgcgcgtcccgcagtcccagttgatcggggccgggggccagggcgccgtcgcttccccagtggacgctggcggcgtggtcaagcctggcgctcaccaaggccggtacaagccccgcagcgccatgtcccatcctgtggtcctgctcctgttcgtcatcttcgtggtcttcaatatgtcgttctcggcggttgacgtgaccgtgaccgcgctgaccaagcagatgggcagggagtcgatcgtgggcctgcaactgtcgctgatcgcggccggatccttgtgcggggcgctgattttcggctcggtcaagctcagaggctcgcgctggcgctatctgaccctgtacttaacgctgttgaccattggcttcatcggcttccggctgaccatgggcaacctgctcgtcctgggcgctgtcgagctggtgaccggcctgtgcgtctcgcctatttacgctatcggcaatctgatcgtgcgcggcaccgtcgactcctccgccctgacagaaggcctgtcctggttgtcgaccggttcctcgatcggcagttcgctgggctccacactggcgggcatggtcttggacacggccggaccggccggtggcatgatgatcccctggatcgtgaccgcctgcgcggtacccctggccctggtgggttgggctttcaatcgccacccggagcgcgctggcgcaggctcgacgaacccaagcgtcccggcgcagcgataacctgagaatagtgagatgcgtcgccgtccgccggacctgccgagcaggaaccccagtcggcgcgcctaaggtttgagcaacgctgtgcctggcgcacgcgaccctgggtcctgtgaggggctctggcgcggctggcggaacgccgtggagccctagggcagcatgaaccgtcgctcccgcacaggtgggggcactaataggaatctaagtggaaatggctaatagagcaacacaagacaatgaattaaagagcgagaaggggtcgaggacccgctcccgctccggcgccaagtcaggtgccggcaggaagtccggcggccgcggccaggccggttcccgctccaacccgcgcaggggcggctcccgttccggcggccgcagggacgccaagccccaggaaccagcgttgatcgcgcctcccaagtatcgcaagggctccatgcgcatcacgcctttgggcggcctgggcgaaatcggccgcaacatgaacgtcatcgaatacaacgggcacatcctgctcatcgactgcggcgtgcttttccccgaggaggagcagcccggcgtggacctgatcctgcctgacttctcctacatcaaggacaagctggaccagatcgacgccctggtcctcacccacggtcatgaggaccacatcggcggtgtgccttacctgctgaacctgcgtcctgacatccccttgatcggctccaagctgaccctggccttcgtggacgccaagtgcgaggagcaccaccagcaccccaccgaggttgaggtcaagggccgggacaagctcaaggtgggccccttcaacctggaattcgtggccgtcacccactccatcccggacgcgctcgccgtctccgtgcgtaccccggccggccatatcgtcgacaccggtgatatgaagatcgaccccttgcctttggaccaccgactgaccgacttgcgcgagttcgcacgcctgggcgagtccggcgtggacctgctgatggtcgattcgaccaacgcggaggtccccggcttcgtcaagcccgagatctcgatcgccccggccttggacaaggccttcgacgaggctcagcgcaagatcatcgtcgcctccttctcctcccacgtccaccgcgtccagcaggtggtggacgccgcccataagcacgggcgcaaggtggtcttcgccggccgctcgatggtgcgcaacatggggatcgcctccgacctgggctacctgcacctgcccgaggacacggtcgtggacctgaaggaagcccataagattcccgacgacaagatcgtctacatgtgcaccggctcccagggggagcccatggccgcgctgggccgcatcgctgacggcacccaccgcgacatccatatcaacgagttcgacacggtcatcatggcctcctcactgattcctggtaacgagcatggcgtctacaaggtgatcaacaagctgatccgcaagggcgcccgcgtggtcaaccgcgacaacgccgccatccacgtctcagggcattcggacgagggcgagctcctgcacttctacaacatcgtgcagcccaagtgcgccatgcccatccacggcgagaaccgccacctggtggccaacggcctgattgcggtcaagaccggtgtggacccgcagaacgtggtcctggccgaggacggcgacgtggtcgacctctaccacgggaaagccgccgttgtgggctccgtgccttgcggctacgtgtatgtggacggcgactcggtcggcgagctgaccgacgatgagcttgagcagcgccgcatcctaggcaccgagggcttcgtctccgctttcgcagtggtcgactccgagaccaacgaggtggtctccggaccgaaggtctacctgaacgccgtggccgaggacgagcgcgagttccgcgctatcgaggaccagatcgtggcccagttggaggatgcgatgtcctccggcacccacgacacctacaagctccagcagctgatgcgccgcaccctgggcggttggatctcccgcaagctccatcgccgcccggtcatcgtgccggtcgttgctgatatcgccatcgacgtgcaggagagcggcaggtagccagtcagttacgctggcggttgtggcgttcatggagttgacctcgctaaaggtgcgggtaagcccccgtctcggattcgtccgggcgggggtttatgcgcatctggaggggtcgcgggtcagattccgcgcccgaagaagcgggggaggactcgtatccagcacttggctgagcggcgcatccatctggcggcgcgacggggcgtcccacaaagtcgctggggctggcggatgagccagtcggccagtcgcttgcgcaagcctgtcagtctctcaggcaagccaacaggcggtaaccctgtcacgagcgcgccggagccgtcgaatgagaagccgctgagccagtggccgagcaagtcgtgtccctgcccgccccagaccacttgggcgctccgatcatcccggccggacagtaggtggttcagggggccggtcagacgatcgttggacagccggtagtccaccagactgccgatcgcacgggctttggcggccgcctgccgctcctgccgggtgagcaccctccaaggatcgaccgcgcagaagacccgggcctgcagtccctggcggatggctagcagaagggccagtcctccgcccaggctgtgtccggtcaggaccggctccgtctcagggtgtcctaacctctgtgcctgcctacgggcctgcctaagcaagatgcctgcttcctcggtctgggcaaaatgatttcccgtgcgcagtatgaaagtgccgggcatggcccacaggtcatgacgggcatcgtcgttgatgttcgtgccggcgaataccaccgtcacgtgggtgccgtccgcctgcccgcgtccgttatcaggcgccgccacgagcccctcgaatccgttgcttgggctgaagagcgaatccagcacccagtacgagcccagccgctcgtcatggaagtcatgccacccgaccaaggtgcgttcgtctccgcgtcccaccccatacgagtactggcacaacaggttcagttggtacagattgaatccgcctggattctccgcccgctcccaacccatggccaatccccaatcgtttcctcggaccggcagggtccgcgccttaccacatcaaaccatgtcgacgccccctctattccgggctcacgttcactgggggaaggcacgtctgggccctggttagtggaggctgcctggtgctttgtacgccgggccgtcgctgctgctggcggcgaaagcggtcagtgcggtcagttgggcctcggcttgggcgatctgctcggtgacccgagctggggcggtgccgccttgaccttggcgcgcctgtacggaaccttgggtggagaggacctggcgtacctgcggggcgagtggtgccggcaggaagtccttgaacgcccgttggaagtcctcgtcgcttaagtcccacagttccacgccgcgttgttccgcgacctgcacgcaggctcccgacagttcgtgggcatggcggaaggggacgccttgcttgaccagccactcggcgatgtcggtagccagggcgaatcctgtcggggcctcggcctccaggcgctcatggtcgaaggtcagggtcctcaccatgccggtgaaggcgggcaggacggtcagcagcgtatccacctggtcgaagacggcttccttgtcttcctgcaaatcgcgggcgtaagcggttggcagccctttaagcgtggtcagcaacccggtcaggtcgccgatgagtctgccggatttgcctcgggcgagctcggctatgtcggggttcttcttttgcggcatgatcgatgagccggtggagtaggcgtcgtctaggcgcacgaaggcgaactcctgggtgttccagatgatgatttcctcgctcaaccggctcaggtccacaccaatcatggccgctatgaaggcgaattcagcgaccacgtctcggctggctgtgccgtcgatcgagttctcggtcacgtgggagaaccccagctccttggccacggccgcagggtccaatcccaaggtgttgccggctaacgcgcctgaaccatacgggctggcatccgcccgatggtcccagtcgcgcaagcgttccaggtcgcgtaggaggggccatgcgtgagctatgagttgatgcgccaacaatatcggctgggcatgttgcatgtgcgtgcggcctggcatcactgtgtctccggcggccttggcctgatcgatcagggtccggcagaggctcacgagctcgctggccaaggcccttgactgccggcgcagccacatgcgaatgagcgccgcgatctgatcattgcgtgagcggccggcgcgcagtttgccgcccagttcgtcgccggctatatcaatcagcccgcgctccaaggcggtcgcttcgtcctcatccgcttcgtccgggatgaacgcgccggaatcaacccgcgcctgcagcaggtcaagagcggattccatgctctccagttcctgctggctgagcaggccgacccgtcccagcgcgcgggcgtgtgcatgggagcctgcgatatcgtcgtcggccagcctccagtcgaactgagtcgatttggacagaaccgccagctcgggggaggggccggacttgaaccttccgccccagagggccaaacgaccctcgattccatcctgagtggccgtacctggccgcgtgccagtgccttcgctggtgccgccgtgcgtatccggtccctgccccatcaccgctcctcgcccttgctcctgcttactgcttccgctgcttccgctgcgttctgatcgctccagtgggcgctcactgcaccgtttcgtccggctcttcgatgccattgccgaagcggatgtcgcgcgcggcggccacccgcgaaggcaagccgtacaggtcgatgaacccgttggaggaggactggtcgaaggtgtcgccggaatcgtaggtagccagcttgtaatcatagagggaggaatccgaccggcgcccggtcaccactgccgtcccagcacgcataatcatgcgaatctgcccggatacatactgctgggtgtcctcgatgaaggcattgagcgatttgaccgccggcgagaaccattgcgcgtcgtagaccagctcggcccagcgcttgtcgatgtcgcgcttgattcggtgctgctcgcgctccaggcagcagttctccagttcttggtgggcggtaatcagcgccactgcgccggggcattcgtagagctcgcgggacttgatgcccaccagccggtcctcaatcagatcgatgcggccgatgccctgggctccggcccgctggttcatctccgtgattgcttgcagcggcgttaccttgtgcccgtcgatcttgaccggtacgccctgctcgaagtcgatgaccacttcgtccggctcgtgggggacggacgggtcggcggtgtaggtgtagcactcctcggtcgggccgttccaagggtcctccaggaagccggtctcgatggcgcgtccccatacgttctggtcgattgagtaagggctctcctcggtttgggtgatgggcagctggtggtcgttggcgaaggcgatttccacgtcgcgcgtcagcgagaggtcgcggatggggctgatggccttgagttgcgggtccatggattgtatggagacctcgaatcgcacttggtcgttgcccttgccagtgcagccatggcagatcgtgtccgcgccgaactgatgggcggccctcaccaggtgcttggaaatcagcggccgcgagatggcggagaccagcgggtagaccccctcgtacatggcgttcgctttgagcgcgagcatgcagtattggtcagcgaattccccgcgcgcgtccacgacgtaagcctcgaccgcgccgcaggccagggcgcgcgccttgatggtcttcaacccctcgccgccctggcctacatccagggagacggcgacgacgtccttgccggtgcgctccttcaggtaggggatggctaccgaggtgtccaatccgcccgaatacgccaagacgattctattgttaccgctcatcgcaaccctttcctcaaggctttcctcagaagatataaatgattatacattagattgcataaaattacacaattggtggattggttcgcttccacgggttcaagccagaagggaggggtcgccccgcttctggccaatcagccaggtcaggagggctttttgggcgtgcaggcggttctccgactcctgccagaccgccgagcgtggcccgtcaatcacggaagcggcgacttccttgccccggtaggcgggcaggcagtgccggaagagggcgtcgtccttggcggcggccatcagttcgtcgttcacctggtagtccaggaaaggcttggaccgcgcggcgtacccgtcctcttcccccatcgagacccaggtgccggtaaagaagcagtcggctcccgtggccgcatcgaaactgattctcctctgcccaactgggagccggcctggtcgatcaccagcgggtagccgcccatctcggccacgccgatcaaaaagctggagcgggtccgcgtgctgggcttgtcgaagaggatggccaccgcctgggggcctgcgaacggcgtgcgatagtgccggtcccgccagaaacgcatgctcaattccaggacttgccgttgctcggcctggctcaggtcgtcgtcacgtaggaagtgccgtagtgttccgctcatgttcgctcctcgctggtgggggtgacttggcccctgcctggtatcgtcgtagcgcttgtcgttgggcgttcccttttccgccatcagccgtcgggcggtgccggtggcagggccgtgaggatgctgggccctggtccatctccgcctgggcggccgcaccggctcgacgggcgggcgctaaacgtcgttgcgttgacggtcgggccgtctttcgggcgccacttcatcgccgcacgggcgggggcgggagtcggctgcacaacggccaagaggccgcagcggtacggtccatcgcaagcgcccgttcactggtgctccaatctttcttatatactattgcgctgcagtgtataactataaatatggcgtgtcgttatgcatcattgcctgctcttgcgttccggcccaccgtttcgctgtaattgctgccgcacgacaggaccgccctttctccgttggcctgttagtcagccgggagagggcggtcctgattcgttgaatcaaaccacgctcgctcgtagcgggtgagtcgacctacttgaagcgcatgaggttggaaagcatttcggggtcttgatggctcaggcctcctagtgggcgggcctggtccatagtggcgatttgggacatttcggcctcgctgagctggaagtcgaagatgttgatgttttcgcgcaggcgggactcatgggtgctcttggccaccatagggatgccgcgctgaaggagccagcggagcatgacctgggccaccgtcttgccgtgggtggccgcgatggatttgaggatcgggctgtcgaaagccgccttgttgccctgggccagaggcgcccaagcctggatgagcgtgccgtgctcggccgcaagcttggccatgtccttctgctggttgagcgggttggtctcgcgctggtccacggcgttcaggtggacgggtgtggggttgtcttggaaggtgccgctgttggcggtcatgcccagctgcccgttctggttggatccccagctccaggcgtgccctgatccatcgatggccaggctgtggctgccgcccgcgctgacgtgcgtgaagcttacattagctggggtcttaacttttattggtactgaggaggccattacaggacggtccccgcccagcaacgctacttcgttgcttctccacgcctaagtgttcccgccatctccaatagcgactgcgtgggtgctttcggcgcttatttgtttgaacttcatgctgctctgaaagggcggtttgacagcgacttcattcccgcccgcaatcgggccttcggtgggtgagagggagaaaccttggctgacgtcgtctgcgtgagcaggccgagggctcgctagagtcgcggctcctcccaccaggacggctaaggagatgagagctatgatgacactcatgaagcgagcgcataacccctccaaccgggtaccggatatacccaactatcctcaaacccgcgaataagtatcaaaaaatgcaacttagcttgacttatcccgagtcccgaaccgtcagtttagcaaagcgatttttctggttgctcaacgtagtgtcgctgctccaaacgccagcaaaaccggtgaggacctgaaggaacagggcgccacgcgcttataaggcgggcctgtacgcctagagcgagtggggtcgcggaaggctgaggatttgcgcatggctgcggttaaagtggtaaaaggtgcctttgcggcgcgggactggccgattgggccgggctgggcgcgggtgagtgggcatgacgtggaaagcacagcagaaaaggacgcaggaatgccaggagcaaatctgacccgagtggaagcgcaagagcgcgcgagcatcgtttccaaccctaaatacgcagtcagcctggatctgacccaggggcccaagagctttatttcagaagcggtcatcagcttcgacgccgccaagcgcggggcctctacgtttttggacctgatcggctcccgggtcgattcggtggagctcaacggggtggctttggacccggccgaagtctggaaggacagccgcattgagctcaagggtttgaaggcccacaacgaggcgagggtgaaagccctgtgcgattactcccataccggcgagggcctccaccggtccgtggacccctccgacgggcgcgtctacctctacagccagttcgaggtgccggacgcccgccgcatgtacgcggtcttcgatcagcccgaccttaaggccaccttcgacttctcggtcgtcgccccgcagtcctggatcgtcttggggaacatgcccgcctcctcctgcgagccagtggaccagcagacccagccgggcaccttggaaaaggcgccagcagagggctgcaagcgctgggtgttcgagaccacgcccaagatgagctcttacttaaccgctatctgcgccggaccctacgccaagtggaccaccgagttcgccaacgaggatgggcgcacggtgcctatggggctctactgccgccaggccttgcggcccgcgctcgaaaaagacgtggactacctcttcgatgtcacccagaagggcttcgccttctacgccaagacctggggcgtgccctacccctacgccaagtacgaccagatcttcgtgcccgagtacaacgccggcgctatggagaacatcgggctggtgaccttccgcgaccagtacatcttcgagtccaaggccaccggcgcgaaaatcaaccggcgcgtggagaccgtcctgcacgagctggcgcacatgtggttcggcgacctggtgacgatgaagtggtggaacgacctgtggctcaacgagtccttcgccgagttcatgtccaccctgtgcaccgccgaggcgaccgaatggtccgacgactgggccaccttctgctcgggcgaaaagtcctgggccttgaccgaggaccagctgcccacgacccacccgatcgtggcgccgatcaatgacctgcacgacaccgaggtgaacttcgacggcatcacctacgccaagggcgcttccgtcttgaagcagctggtggcctacgtgggcagggagcgcttcttcgagggcatccacaactacttggacaagcacgcctatggcaatgccaccctggccgacctgctggccgagctggaagccacctccgggcgcgacctcaaggcttggtccgccaagtggctgcaggagtccgggattaacacgctgacgacgaagctggcctgcgacgagtcaggcgtcatcacttccttcgccattgagcagagcgcgcccgaagagcatccggtcctgcgcccccaccgccttgccgtcggcttctacagcatgggcgaggacggtcaggtgatgagaaccgaccgtttcgaggtggatatcgacggcgcttccacgcctatcgccgagctggtaggcaagcgccggcccgatttcatcttggtcaacgatgacgacctgacttacgccaagctgcgcttggacgcggattcgctggcgttcgcgcgggaccacctgggcgccttcaacgattcgctggcccgagccatcgttttgctcggattctgggacatgacccgcgacgggcaatacccggccgaggatttcatcgacgtggtcttgcggacgttggccaccgagcgccagtccaccaccttccgctacgccctggcgcagctgtcgaccacggcccactcgtatgtggcggacaagacccggcccgaggtgctggaacatgtggcgcaaggcctatggaagctggccatggcggctgagcccggttccgacgagcagttgcaactggtccaggcctacctgggttacggcgatgacgaagacttcggcgaccacgcccgcgccttacttgctggcgagagcgagctgaaaggcttggaagtggacaacaacatgcgctgggccgtgattcacgctatggccgcccagaacatggcttccgaggcggacatccaggctgagctcgacaggcgcgactccacggagaaccgagagttcgccatgggcgcccgcgcggcccggccttccaaggcggccaaagcatgggcctgggatcaagccttgcacaacgccgacctgaccaacgcccagatcgaggcggtggcggacggcttctccggctccggggacgaggatctgttcgcgccctatgtggacaagttctttaaggtagtcgactgggtctggtcccacaagaccttccatatcgccgaaaccttgctcaacccgctctccgcgggcggcctctacccctacaaggcggacccggccgccctggtgcgcgctggcgagcactggctggccgaccacacggacgcccccaaggcgctgcgaggcatgataatccagaacgtggaagcctcccgccgagttttgcgcgtacgcgcctacaaccaacacttgtccaagcgcgcccgctgacccgctgatcgacaaaggcccccaaagcctcacgcgccgtgcttggcgggtgaaggcttcgggggcctttacgggcttgcgggcttggggctggcgggcgggctaagctggtcgggtatgcttttcgcgggcctgggggcccgtccgcgcgtgagacaagaggagtacaatgccgaggctgtttggaactgatggggtacgaggactggcgaaccgggatttgaccgctcagttggccctgaacatgggcgacgcggcggtgcgcgtgctgggcgctggcggtgagcgctccggcgggcgacgacgggccctgatcgggcgggacacccgagtctccggtgacttcttggcttccgccctggcagcaggcatgtcggccggcgggttcgacgtgatcgatgtgggcatcatccccacccctggcatcgcctacctgacctcggtgctcaacgtggagatgggtgcggtcatctccgcctcccacaaccccatgcccgataacggcatcaagttcttcgcccggggcggtttcaagctgcccgacgcgaaagaggacgagatcgaggcggtgctgggccaggactggaagcggcccaccggcgagggcgtgggtcgcgtctcccacgacacggtgaccgccacgaacatgtacatcgaccacctggtggaatcagtggccccgatcggtcccgacaagacccagcccaagcccctggacgggctgcggttggtggctgactgcgccaacggcgccacttcggtcgtggcgccggaggctctgcgccgggccggagcggacgtggtcgtgattaacgcctcgcccgacgggtacaacatcaacaagcacgcgggctccacccatccagagcagctgcagaccatggtcagggcctcggacgccgctatgggtgtggctttcgatggtgacgccgaccgctgcctggcggtggatgaagacggcaacatggtgaacggcgaccagataatgggcatcctggcccgggccaagcagtgtgacggcaagttggccaacgacaccttggtcgtcaccgtgatgagcaacctgggactcaagctggccctgaaagacatgggcatcgccaccgtgcagaccggggtgggcgaccgctacgtgctggaggagatgctgcgcggcggctacaccctgggcggcgagcagtccggccatgtgatcaatcgcgagttcgccacgaccggcgacggcacgctcacggcgctgaccttggccagggaagtggtccgctcgggcaagagcttgaaggagctggccgccgacttcccccagctgccccagcagctgatcaacgtgccgggtgtggacaaggccgccgctcccaccaatgccaaggtccaggccgctgtggcgcgtgaggaggccgccctgggcgacaccggccgcgtgctcctgcggccctcgggcaccgaacctctggtgcgcgtgatggtggaggccgccagtcaggagcaggcggacggggtctgccgccggctggcgcaagtggtgaccgacgaactgtccctgtaaggggcgacaataggcctttaaagcccttttccggcctgtggcccgcgccccgcgcgctggacgctactactttgacgttggcgggtcgccgtcggcgcgaatcgtggaggaagcatgtttaccaggaacgcgaatgtggacgccgaactcaaccgcgaggtggagcggatgctggcccaggcgggtgaggacctgattgtgccgatcgtgcagttgggcgagccggtcctgcgccaggaggctgtcgaataccgtggtcagctcaagcgcaagaccctgctaaagctgattgaatccatgcgccgaaccatgcttgacgcgccgggggtgggtctggccgctccccagattgggttgggcctggctttcgcggtgatcgaagaccaccagcgcgacagtgaggacgacccgcgtgagatcgccgaactgcccttccgtgcgatcatcaacccgcattatgagccgatcggcgataagaaagcgtccttctacgagggctgcttgtccttctccggctatcaggcggtgcgcgaacgctggctggacgtgcaagccagctgggaggacgagaccggcaagcgtcacgaggagcgtctgcacggctggcccgcccgcatcttccagcacgagaccgaccacctacgcggcgaggtgtacatcgaccaggcccagacccggtccctgtccagcgacgataatttgggcgaatactgggcttacgatccagtccccacccaagccgccaaggagctcggcttcgagctgtaacggagcgcgccggcccgcatcagtggtccagcgcaccggcctgtgaatgccccccccccacccgctcagagacggagggtgatgccctcggtcagctgcggcccatccccggtgaggggcgccacttgccagtgcaggagccgggcggacagggccaggccggctcgggccgctgtcggcaggatgcgctcgccgtccacctccgggtccagccagtcgtccgccaggttacggtcgatcaggaccggcatccggtcgtggacctcggctgcgccgccctgggcctgggtggtcaggatggtcccagtcaggagccaggctgaacgctcatccgcccgccaccaggagtagagcccgccaatcagcaacggttccccgtccgggaagctgaagtaatgggggtcgtgggaggcgctccactcgtagtagcctgaggctggtatcaacgcccgatggctgcgcgcggcctgcgcgtaggtgggcttgtccagcgctgactccacgcgggcgttgtgggtggggtaggccagcttaggggacgcggcccaaggcggcagtaagttccacagagccgcgttcaggtggcgttcgccgcgcatgtcttgagcgatcagcgcgatccgctgccccggtgagatgttccaggaggcagggggaaggcttgggccaggggtcgctgaaaagtcccgttccaaagcttggtagtccacattagccgcgaatcgtccgcacacgaaccttattctatcggcccgcgtgcgctctggccgggcctgggcctcgctggcgcaggagcactagaatgggccttgtacacaagcaagcctagataggatgaaggtgctcatatggatgagaagacactggttggcaagctgaccgatgcgcagaccgtgaacgatgtgatcgagatcgccaacgaggccggtaagcagctcgacatcgagcacgccgatgcgctcttcggccggatcaaccagaccaagaacgaggtggccgagctctccggtgacacgatcgagaagatcgtcaaggaggtcttcggcatctgagccggacgctcagggccatccgcaagcccgccccgctggcgacgccagcggggcgggcttcatgcattcctgagggttaagcccttttcacgcgctgcgttcgtttgggcgggaagtctggtgtttgccggccggtcagcgagccgaggtttgttcttgaccggcgcactccacccgggtgcgggctgggtcgatgcaggccgggtccagggtcagctggcccactgagtcagcgctgatgacgccgcccgaggggttgaggatgctgtctatccggccatccacttgagcatggacggtggagtattcgaacgccagtgtggtgttcagaagcttgcagcgccgcagggtcaggttttctatgtagcacaggccttgcaggctttcgatcgtgcagttttcgaaggttaggttgcgtgagttccaacccaggtattcaccatagatataggagtccttgaccgtcacgtcgtgggtgttccagaaggcgtccttggagagcagccgggagtgctcgattgtgatgtcgcagcccccgtcgaaggcgtagttgccggacaggttgaagtcgctggcgtgtatgccgttgctgtccttgccgaagtagtcgccctgggcggtcacgccctccaggtcgatgtccgagcatgtccatagggtctcgtccgcgttgggcatggacacgtgccgcagtcggatgccgctggagcggcggaaggttttgggggcctcgattgtcgaatcgcggatggtgatgtcgtgggtgtaccagatgccggagcgggccatctcgaacagggtgcaatcctgcatgcgcacgtgctcgctgtaccacagagggtacttccactggaaaagcgcgcccgtgaggttgatatcgctcgcatgcttgagaggggattcaccgtcggcgaaggtcgtatccacgaagtcgtgatcatgggcgcggaaggcggcgcgctctccggtcaagcgttcttggcgggtggacggccgttggtggctggggtcgcctgtctcatgctggtttcttgcttccaagatgccttcgtcctttcctgatcttgtctcttcaagatgttgccgcgttttaacccctcaaggaaattcatatcagatgtctattgttcgcacgtgcgtatgcctatcgcttatgattctaggggtttgtcgggtggtgtttgagattcgctcctggatgatgacctggaagaagcgcaggggggaaggaggctgggcgggtgaacgagtagattcaatgggcggtggatggcaatgtgcgccatccaccggccacatgtgctgccacctgccgcccaggacactggctatcggtcctcctgacggggggccagtgcgtttgttttcttgctggttcacccaccgcctccttcgttgacccccggggcttcctcggctggcgggctcagacttgcgagacccgtaggagggacttgattgtagtccgctggtccatgtcccggtaagcttgggccacgtggtccaggtcatattcggcggtgaacacgcggccggggtttatgcttccggccagcaccgcatcaagcaggaccttctggtcccaggtgcggaccgaggcgggtcctccgcgtaggccggtgttgtggtagaaggtttcctcggcgtccacatgctcgtcatgaggaacgcccacccttccgaccacggcaccgttgcgggctatggccagggcagtggcggtggattgccttgagccgacgcattcaagtaccgcgtccgcgccccaaccgtcggtcaattctctgactttgtccacggcttcccgcccgcgttcgctcacgatgtcatcagcgccgaactcgcgggccatatcctggcgttccttgtggccggatagggcgatgatgcgattggctccgcgcaacttggcggcgatgaccccgcacaggcccacggcaccgtcgccgaccacggctactgtgtctcccggtttgacctccgccatagccgccgcatggtaaccggtgcccatcacgtcggagagggtcaacaggttgtccagcatctgatcggagaagccgcgcgcacgctcacggccgcctgggaccattacaaccgtgccgtcagccaggggcactcgcatgtattcggcctgtgcacccaagccaggctcgccggcgtcaaagaacccaccgttcgggcaagtggcttcgaaaccggccttgcaaacggggcagaccccgcaggagtaggcgaaggggacgatgatgaaatctccgggccgcacggacgagacgcgcgaacccacctggtccacgacgccgatcgcctcgtggccgacgctgctgcctgccgggcgggggctggtgccccggtaccaccacaggtcggacccgcacacgcaggcgcgcaccacacgcatgacgagctcatcgggattggtggggctgggcttgactgcctcttggcattcaatctggcgggtgccttggaaaatcgctgctttcatcgtttcgctccttagcttaggaatcaaaggttctcgcgggggtccgtcgggcctcggggccgcatgggcagattgggcctgttcccggcgccgcctccactgcggctggcatggtcctcgacgtccgctgccgcgcgtcgccgctggggccaacggttggttggctggttcagacggtggtgaagctgaagttcacgctgaccgtgccgggtctgagtgtctgcgcaaggctttcgggctgctccacccatcccagtctggtgtaggcgtaggaggtgcggaaggtcttgaagaatagggtcaggcagtccgaaccgtagagcatcaggtccccggctcggatttcgccgaccgcctggggctcgctggggatgggccggtcgaagaagtggtatttttcggtgccgttgagctcgttcattcgcagggtggtcggcatccgtcgggtgaactcctgggccgcgcagccgcttgcaagccgcgcctggaagacggtgccgtcgatggtgatgttgatgggggcctccttctgatccgcttggtcctgatcgttggcttgcagcctggtaggcacggcgccgggggagctcgggaccgaacccgtggctgcttggtggatgaggggatcggcccgcttgcgtagcaagctgaaccggacatggcgagcagggcccgtcaggcaagccgccagggcgcttttgcgtatgcgtgtccgtcgcgtcatggctgtcccctctctgattatctgcaattgcttgtcagcctagaagtgccgagggtatatatcaaatgtttataagtaatgagatttcatgcttattgagcatgggttgtagggttggcttggaacatgcggtcgactagtcgctggatataaaacgaggtgggatatgaacttacgggtcctgcgctacttcctggccatagtggaagagcggagcatcaccggcgccgccgaatacctgggcatttcccagccttcactctcccggcaaatcaaggatttggaatgctcgctgggtcacaagctcttcgaccggggcagccgcacgatcacgctcaccccagccggtgagcttctgcgcgatcgcgcgcgagagatcgtgctcttggccgatcgcgccgagagcgagctgacctccatggaccaaccggtcggagggtccatttacatcggcgccggcgagtcccagggtttcaaggtcctggccaaagcggcgcgcggtctgcgtgagcgtttcccccagacccgtttccacatctacagcggcaacagggatgcggtcaccgaccagctggagtcggggctcctggatttcgccctcgtattcgagccgataggcatcacccactactcctacctcaacctgcctggagccgaccagtggggcctgctgatgcctcgggactgcgagctggccagccatgatggcgtcacggccgaggatttgaaagccttgccgttgatcgtctcccgtcaagtccatttcgatcgcgagttcagcggctgggggagcctgatcgaggaggacctggacatcgtgggcacctacaacctgctctacaacgcttccttattcgtcgcccaaggctgcggctacgccctgggcctggacgggatcatcaacgtcaccggcgagagcaacctggccttccgcccgctcaagccccggctgacctcccgcatgaacctggtatggaaggccgaccgccgcttcacccccgccgcccgcgcctacctggattttctgcaaggaagtctggccttgtaggccctcggctatttttaaaaaggagaagggtctcacatggccgtaaagcagtgagagacccaatgcgattatgccttgacttggcctagagtctgtttttcatccattccaatactagttgtatggctttgtcgctgcggaagccatatgaggcatgactggcctgatccagcttgtagaaggtcacgtctttgcccaaggcccgcatggcgacacggagctattctccccgaatccgcacccaatgtgccggcttgggcgcggatgaatcttatagcggttttcgcgtcttgcgtctgcgcggcgaagggggtctcctcgctggggcgatattctggcactgccaccatgtagcctttttcgcatagccgggtgtgcaggccgttgaagctaagcggatcaggcttgtggaaagccgcaccccgtaagaagactattaccggccaaccgcttaccggcttgttatcgggcctgttcgggtcatgatggatattcggccttggatgtcgctcccttcaatgggcatagtagaatcccttttgaactataacgaaaatatgcgttcatgcatttaatctgcagcagcatgactattaagccagtcgtatgcatacaaatggtgaaaccctttgcggattggctatttgtctcacgcagcgcatcgcctgttcaacaaaattcggagattctatattaataaaaataatacataatatcgtagtgctgaacagcggatattccggattttgttaaaaccaaacaaggttaaaagtttttatggaccggatattgaaccactcagcaataatgccctgataacgcagatggcgcatgcggatattaggcgttgccacaatctgtcgagtcaaagttctttgttcaacggatgccaggcggattcgaaccgggaccccagcttaaagagcgcactacccttactgttgagacggaacggcagcaatgcctcacatgcacactttcatgacttaggagtccattctgtttgccattaagtgtttaagctgcagcacggagctacctcatgacaatcgggaagccatgcgtgaggaagagtccaaacgccagcgcaaccaccgccaacacgatcggtgtcagaattgccacagcggacgcggcgtccttgctcttcctggcgaagcctatctcagccaaggcgatcatgacgagcgccaggatgattttgacgaccaacagcacatcgacatggggccaactgcgcgcaagcatgagcaccccgctcaggatgatgaggatatagcacacgcgggcgatcatcgcccatcccctggtcattttcgccggccccagcaatcccgccgccaccgagacaaccaaaaccacaccaccgaacaaatgcatccagacccagaccatatctacctccccatagcgcccgccgccacaacaccttccctcaaaatacaccaatccgcgtcctccttggaatgtcgcggcggacgcaactacgcttcggccgggactccgtcatcttcccgccagccaaccatcgtccatcgcgcaacctcatccgtcgcaacctcatcaccacagccgtcggcacggggcagggaagcatcggcccatgagcgcaaatcagaacgtttcaggcatgatcctggaaaacgcctctggctacattgacggcattgatgaccctcgggaatcccacatacggcaccgtctgaaggatggcctgaacgatctccgcctgcgtcagccccacatgcagggcggccgcgatatggaccttcaactgtggttcggcgccgccttgggtcacgagactacccaaggtgacgagctcacgttgcttggcatccagcccgtcgctcgcatacacatcaccgaacgcgaattcgacgatccaccgccccagctcgggcgctatgtcttgcaacgaatcgacgacggcctggcctccttccccatcgatcgtttctaatatcctcgaaccgcgttcgaatcgtgactccgtcatgttcattccttcaccttgatgttcatggtcgttcacagagtaaagtatgaaccagggttcagggcaaacggggagcggtcatgagaatcagcgaagtagcgggtaaggtgaatctgcccatatccacactgcgctactacgagcgccgggggattgtgcaaccagagcgatccttggaaggataccgggattatactgagagcgaccttgcctggatcgctttcgtgcaacgtctcctggaggtaggcatgcccctggtccaggtggaggaatattcccgcttgcgcaagcagggcgactcaaccatcccgcgacgtctggagatgctctattcccaacgtgaacggcttcagtcgaaaatgcgggaactccaggagcaaatgggcttcatcgaccggaagatcgacacctaccagcggatgatgtgacatcgcggcgcactacggccgaacatgcatcacggctcggtgcgcatcggaccggctgcctcgccgcggccgtgacttacaaggccgaacagacccgtcctgggagattctctcgtgccctatatcgaagtgattatggctgtactgccaaaccatcaaggcttgaaagtattccacgttaatgctgatcaaagaacaatgtgaaaggagaacgcaatatgttgactgctaaagatgtagcaaatgtagattgggattaggctcaaaggttctctggcgaagaaggtcaatgcatgctcgacggcatactgatgcgggcttccggagctgaaaccccgagaatgcgaagcaaatattatttggccagggtcgcccccgtttgggtgacggtccgcgagaagagacagtaagagacagtatcggcgatcttgaaaatgcccaagtcagtgagaggtcccgtggatgtccagtacaagaagaaagggtatgctcaccgctctgaatacttgcgcgatttgattttcgttgatcttacaagtactgcccagcatgcatagtggggcggctgccccaagccctgtcgagctggacagctcgaccatcaatgcctccggcggctgccgcgtggcatgagctttgctcatgccacttgccttgcgatgagcaaagctcgatgacgaatctgaatgcgagtattacaaaattagatggtaactatattttagtttttacatagttgccggctaaaccaagttttgtttcttacttttactaagttattctgcagtgcttcttcttggtggatatccatagtagggataatggttatagggtatgtcgtgcccagttgctagctggaaccatgagtacctgtgacctagtgtgttaatactgtttttcagattgtaaggcatatgtggccaccccgaactgagttgcatatctgaaggctgtatagaattccctatagctgctgtaaaagcagagcaattgttcatgcttgccgaagccatgggcttcgacggggcgacttgctttgatcggaggatgctcctatactgcgataactgagaccggttacagtcttagtgggccacggaggcgcgcttccgttggccgattgtgcagtgcatgcaaagaagcagaaaggagaacgatggctgacatccataatcccatcgtcctgcaaagggctgacccgtatgtcataaggtttgatggcatctactatttcactggttcctacccgagcttcgacaggatcgccctgcggaaggcggatcggctggacgacttacaaacggcagaggagaccgtgatctggcgcaagcatgagaccggtcccatgagccacttaatctgggcgcccgaactgcaccggattgacgacaagtggtacatctacttcggcgccgcccccaacgacggccaatccgacgacaccttcaaccaccgcatcttctgcctggagaacgaggctgaggaccccaccactggcaactggatcgagcgcggcaaggtcgataccggcatggacactttcagtctggatgccaccagcttcgagttcgacggcagccagtatctggtctggggccagcaggaccttcgaatcgatgggcattccaacctctatatagcccgcatggccaacccctggaccctggccaccgagccggtcatgctcgccaagccggaattcgattgggagtgcatacgcttcaaggtctgcgagggacctgcggtcatcatgcacgcaggtcgtatttacatcacctactcggcatccggcactggtcctgagtacgcgatggggatgctgaccgccagcctggactccaatctgctggatgcctcttcctggagcaagtcgcctcagcctgtgttcacgacaaacgcagaggcgcacatgtacggccctggtcataactccttcactaaggcggaggacggagtggccgatgtgatggtctaccacgtgcgcaattacaccaagatcgagggcgatcccttgaatgagcccaaccgccacgcctgtgccaagaccatctcctggagcgagtctggcccggttttcggcaagcctgaggccatgacccgttgggtgccgaccggtcgggatgtgctgcctcccgacggctcccactgagagcggcactgacggcatcgtaaggccgcgacttgcggcgagctggcggcggccagtcaaataccaacgacggaaggcgacacacaccatcatgaaatccttacgcaaaccaatcttctggaacttcgggctcctttatttcttctacttcgccacctggcagctttcagccacgttcctgcccatgtggttgcaggacacagccggcatgaacgccacccacatcggcatgctcaacacaatcgccgcagtgggcgcactgatcctgcagcccatcttcggccccttgcaggataagctggccctgcgcaagaacctcttctacttcgtggtcatatgcatcctcttcctgggccctctgttcaactgggtcttcctgccgctgattcataccaacgaaatcgtcggcgcggtcgcggccggagcctatctgagcctgtgcctgaacggcggcgtgggtattatcgaagcctacaatgaacgctcctcgcgagcctatggcttcgagtacggccacgcccgcctcttcggctccctggccggcgcctgcgcctccttcgtagggggttacatgtactcagccaatccctcctcgattttctggggcatgaccttctgcggcgctgtgctgattgtgctgatcagcctggtgcgcgtgcccaaggatgctatggagcgcgctgagggcgtggacgctgagggcggcgaggaggacctggcgatcagcaaggacgacttcgcccggaacacgtgggctaaccgcagcttctggggcctggtcctgctgatcatcggttcggccaccatgtatgacgtcttcgatcagcagttcgccaactacttctccaagatgttcgtggagtccaacatgggaactctggcccagggcgaggctttgttcgccaaggtcgtctctgtgcagatcctgcttgaggccttcttcatgctcttcatgccggccttgattaacaagatcggcgccaagaccggtctgatcatctacggcacgatcctgttcgtgcgcgtgttgggttgcgccttcatcccgaacgtgccgatgctgatcttctggcgtctgctggcctcgttggagatgcccttcatgctggtttcggtcatgaagtacatcacgcgcgtcttcgataagaagatgtccgccacggtatacatgtacggtttcggcaccgccaagcaaatcggcgtctccatcttctcaatcgccatgggagccatgatcaccggcatgggattcaagcacgcttacctggcgctggccatagtgatcgcggtcttgattatcctgggctcctcgctgatgcgttcggacagcaaggtcattcgttccaccgccgccaaggggtcggtcgccgactgaccgtaagccggttgtactatggggaaggtcctacgcttcgctctggcgcggcgtgggaccttcgtccgttgtcaggcgccaggcctggcctgaaagagtttagtcggaggggcaggccttgagcggcaagaagatgaccatcagggacatagcgcaggaggctggcgtctcccgggctacggtctcgcgctacctgaatggcggacactgggttagcgagcaggcagccgcgaaggtgcaggccgtcatcgaccgcacggattacgtagcgaatgagcgagcgcggtccctggccacgggccgttccaactcggtggcgttcctactgggtgaacctcaggagctgctgttcgcagacccgaacttctccacccttctgcgggccatcgccgatgaactggggcgcaaaggcatgtccttgattatgatgactaccgataaccaggaggagaacaagcgcaacctgaagttcctgcgagggggtcatgtggacggcgtgctcttagtggcctggcactatggggtgcgcaaggggctgattcattccctgcacgcgatggatatgccgtttgtagtcgctgagtgcccggaggtggacagcgattcgaccagctatgtgcatgtggatgactaccatggggcggcccgggccacgcactatctactggagcgtggcgccaagtccgtagccatgatcgccggaccggaggggcctaccggcgccctggagcgtgtgcggggcttcgaggacgccatgcgctcccggggtcagaaccccgagtggatcgagcggggcgattattccaaagccagtggttacgatgctgcgctcagactcctgaagcgggcccctcaggtcgatggtctcttcgtcgcttccgatttgatggcgattggtgccatgcaagccttgcgttcccaaggccgcgacgtgccagcgaacgtgcaggtgatcggcttcgatgaccagcagctggcgcaaatctccgagcctccactgaccaccctgcgccagcctttcggcgagatcggtcgtaagatggttgaccaactgattgacctgattcatggaggctccccagtaggcaccatcctcccgctggagctggtggtccgccaaaccacccgttgattcagtcctcggctgcctgactggctaccgtgcgctctcgtgctctcctgggcgacgtgggtcaggagctcggttgaggcgacggcggcgataggggagtcgatgctgctggtgaggatgcaatcggctcactcctgcttggcgccggcagctaggggagagcccttgttgtcatgaaagtcgcaaccgaccccacccagtatggcagcctcgtccagggcgcctacgcgggcgaaatccatacactggctcaagggaacttaaggctgcgcttcagcactcgtttcctgccgcaacatgcagtaagggcggaatcgtgtgggcgggtatgagcatcccgtggtcgcagcgtttggaatgaatcaccgccaatatggaatcctggtggatgaccttccttctcgaacacgttgcaatcgaacagcggtcttgaaggcgttgctcctcaaaaatgccgcaggtagcagcccccccccctgccgcttccgattatgctgcggcgcgcgggtccaagatggttgagccccgcgggttgtcggaggactccaagtatgagctcactattggcgactgggagcgctcttgccgcttgacgagccatttaccgttcttcgcggcatgctgtcaatgctcaaggcgagcttcgttcagtctttcatggttcttccttatcctcctggtatagcggtgctgtcatatagttggggagaaacagtaccgtggcgctgcccggcccatacccggtgaggacatgccaattccttgggaggggacctggatctgcttttcaggtcgcctcacttctttgaaatatccaacgatgttggacggcttcatacggatgcatcctaaaaggagatacccctgaagcatagtgaagaacaaatggaccgtatgatctatgttgatattccgcttgcttatcccggtgatgaagtggtgaattatgcgcttaccctatatctgacgttcagccaactaagtcgagcgaccctggaggaagagtggaagggctttagggtgaatgcaagaaaacaagcgatatagcatgtgagattcatcgcgcaccagttcattcgcgggaatgtttaaccggggtcttctggaaggttacgggtcgaatcgatccttatcaacaatgaagcaaagaacccataccgacatcatcctgagttggaagcgattcgtttgtttccgttgtggggcctgtttggattatcgcctcttccggtggtttcttgtgccacgcacttttcgtttagggttccggaaaggattgggtttttctttgtctgtttccgccgcctattttctttaattacgggcagtccaggatgggggatgcttgcattccgcagaggtttcctgtaggcgtgctctctaaattgttgactctttcgcaatctcacggttctctttttcatgttttaccccgtagcagcgataagtatgagagatgagtgatgacgcgtactcgcggggcgtggggggggcttctgaagaggaacaaggctggtcgggttgtcgcatggctggaacggcagcattaccgcacaacaagggaatgcgggtatggcggcatcccacgggcggcgaacaccaagcccgctgtggatgggggctgttcgaggatttacctacccgcaggagaggctgcaccactggaaacggggcggaaactagggtctgcgcgattcgatgacgcggaacctgggggaggggcaagtatatcccattttctgccatatttcaaaagctgaccggtcgggggaatcacagccgagggcttccgcgctttggtatgagggggcgacttccccgaggggccctggccttatgggttgtgtgcaggtgttgcgctcgatccgggaggaggcgtcgaacgcgacttgcggcccatcatggttggcgagtacccagttcgtcctcggcaggtgaacgatgggtgaaaagatgaagattgtgccatcagtcaaatgagtttccggcttttttatcagacaggaggagcctacttgtgtgcgagggtcttctgcagcatccggctcaatccccccccctctaatgccaaagctaatcaggcattacaaaagagaagtggaaaagtggaagcggaataaagatgaattcaatccgaacatatggagcagcaatgatgctgcttacgcgtagttgttgaaaatttgcaaataatatcgcctttttgctttaaaaaggatgcgcgcttcccatgtgtttatagtgcaggtatcgatagtcttgctcgtcagccgacgcatggaaaagtcggagaacaggattaccgctgtgtcatggtctgcgacgaggcagtccgcgtgaccatgtcgagtgacggaattgacgcctctgcatcggtattcgtattcgcaagacgggtttgcggattaaccgaggaggccagacgaggtcaaaagagaaagataaaggtgtagagcgcatgaacgtattccgcaagacgcttgcaggattggtggccggtgtcgttctcctggcagttgtaccgtcggcgatgcctgcgtttgcgtctgaatccagacaaacggttaacgtgactcccaatccttggtatgctagtggccctttccaagggtggggaacatcacttgcctggttcgccaatgcgacaggcaactatggagagcctggttcaatcagccaatccagcggcaatcctcaatccgacagcaaagcgctagagtatggacggcagcttcgtgaggatttttatacgagcattttcggtcggcaaggtctcggcctcaataaggcgcgatacaacataggcgggggcaacgcctccgatgtggcttatggctacccatttatgaggcagggggccgcaatgcccggttactgggtccaagatcctaatggatccttggggctttacggcggggtgagtactacgatgcggaataagaacgccattgatggtgcgtttgatccggaaaaggacgactcctatgtatggggtcctgcatccaggaactcctcggaggcttacgctaccaaagctcaggaatggtggctgaagcgaggcgcggagcacaaggatatcaaccaggtcgaagcggcggccaatgcggctccgtggttcatgactggaaatgggtatgtcagcggggggacgagtggaaatgccaacaacctggtcgatgctgacaaatatgcccaatacttggctgcggttactcggcacctttcccagctcaaagcagcgaacgggaaccaggtctcgattaatacggtagaaccgcttaacgagtcggagacgggatattggagttcgcctcaagggagagcttcagatacttggccatcacaagacaccgctttaatcgaccggtattggaaccgttactaccaagacaaggacaagagcaaaaccccttatacaagtgaggtgaaaaagccccaagaagggatgcacgtggatgtcgagaccgcgggcaggactattcggtccctcaggtcggcccttgacgcccagggcctgcggcaaacgcaagtctccgcaactgatgcgacggattcagggcagtttgtcgattcttaccgtcactatccccaagaggtcagaaatgctataggccagtataacacccatgcctatggcacgaaccatcagcgggtagcccgtgatatagctcagggcgacggcaaggctctttcgatgagtgaggtggatgggtcctggcaatccggaggcttcaacccgtacggtttcgataatgccctgggaatggccggcaagataaatagcgatgtctatgccctgcaatcaagggactacactttctggcaaatcggcgaggatctctacaacgttgccaccggtgataaggacatgaatgggaatacggccaatcccaagggcgaggacaccaattggggtagcgtttttcttgattacgattgctccgtggctggaacggacggcaagctctactcccgcagagaggtggacaataatgggggcagcaccgcaggaatccatccctgtcgtatagtggtcaacgcgaagtacaatgcagtgcgggcttacacccaattcatccatcaaggcgatgccatcactgccaacaatgccaccaaggacaatatgacagccagctcagccgatggcaaggttcagaccgtaattcaccgcaatggtggtgatcagccccagactctggtcatcgacctatccaattacgaccgaatcgactcgaaagcggcgggaaggcttttcctcaccacgactccggaccatcagcaggatatatatacagccaacatggactatatgaaccgctactccaataaggagcaaccgcatgcagtcagtataaatacgacgaccaagacggctacggtgaatctgcctgcccgatccatcgcttccatacagttgacaggtttatccggggtctccccccaggctcaggtgatggatggcagcactatccaacttcaagggcagcaatcagggaagatgctctctgcggcggacgatggccaactcacgctcgaagacatggccaaaacccccgcacagggccgggcccaatcattcactgtctccagtgtcgcttctcccattggcgctcctatgctgaagcgatatcttctctcttccgctaatggaagccggttcctgggtgccgatggccgaatgcaaaccggtacgcgggaatcggtaggcgccgatgcgaaatacatctggatactcgataccgagaacggcaagacgttcagtctggttaaccaagcagacaaggttgctttggatgtggccggtcaggagactgatgcaggagcatcagtcactgtggcggagtcgaccggggactgcaaccaggcttggtacttccggtccacgatgcctactggggcgcaggatacgactgtccaggtacctctcggaggacctgtgtccatgccggggacggtggttccctattacccttggggaaagggggaacccgtctctgtggtatggcggacctctacagtgaacgtcaacaaggaaggaacctaccgggtccaaggggtcgcaactgatttcttcggtaatacttttccttgcaatgcatcagtgttcgttggtgcgctgacagtgaccgatcctgcttcggcgaccgtgctcttcggctcagacgcgagtgccgtccgcaaagtgatggaaaccactgctgtatatggtcatgtcaaagcttcgccggccataaaggtcgatcctcaagcggtgacttgggattatacggatctccaggggaaactggaccgggccaaagaggggtcggcagtgggcattcatggtgctctcgcaataggacaaggccgttccctgcctctgtctttcgccctatatctggaagcagctatacctcaaaacgtcgctgatgtcagttgcaatctgaccgtcacggaccaggatgtcgagtacgggaaagaagaccagtggaggaagctcacagatggcaatacgaaggaagaggcatgggctacttggaattcggctggtaactaccgtcacagtcctaccgccaacctggacttcgggcaggtccgccaattggaccgggtgacgatcacttacaaggaccacccgcccgtgtcggccaaagccgagtacacggataacggcatcacgtggaaaccccttgggcaaattgctctcaatccccagccaggacaaaccctgaccttccaagcgaacagtatggtgggggcaagcaaggtccgcatcgttaataccgttgacaatgcttggatggatgctacggaaatagaggcccgggcccggccatgggtcggcccaatcaggaatttggcctggggcgcaggtactcatttcactgtcaacgccgacgagggcgacacggccggtaaagccattgatggccatgtcggcaagggctggtccacccggtcggcacctgcgaacattgacccgacggccaccttcacctttggccgtgttcgcaccatcactcacatcactacgactttctatcgtgatgggcgcgcatcgtggcccaaggctcagacattggagtataaggataaatctggcgcgtggcacagtgtaggaaccaggtcggggtggtatcttccgcaacccggtagtggcgattcctcgactgacgctgatactcctacggcggattttgtcttgatgactcccgttgaggccaaagcggtgcgtttggttaatgttctccaggacaaccggacctacattaatgtggcggaaatggaggtgtacggcactgagagcgtctcgaccttcgaacctgaacccgggaacgacagcgacctagccgatctgcgtctggatggacagacgatcaaaggtttctcgcctcgccaaagtgattatgtggttgatttaccggttggtgcgcaacgcaaccctgtgctgcaggctttcagccgagacaacgccgctaatgtggttctacaatctgatgctcagtcacaggtaggtggcaggaccctgatcacagttgcgcccgccgatggatcccaagctagaacctattccgtgctattccggtctttcgacttgcgtgaattgaagattactccgccaatgaaaacggactacggcataggcgagccattcgattcgcgtggattggaagttggcgccgtctatgttgcgcatgatacaggggacaagcaggtcaagccccttgtcctgagcgatcccgatttgtccataagggggttcgactcgtcagttcctggaaggaagactgtcacggtggcttaccggggagtgaacgccagtttcggggtctctgtaagaagaactggggagatctcttccggtgaaggcagctatggcgtgaacggacagcaatcgcagtcggacggacgccttcatcctgctttggcgaattcagggaccgcagtggtgccgatattgctgcttgccacgttattgacgtttgccgcgctggccgcttatatagggaggcgatactggtcgggtaagaggtaaaggagagaggggaatgatgctgcgctcgagtctgtgcgtttgaggcgcggacgcagcatcatgccttgttttcagtaagaggcgatgctgtttcaggggaaggggaagtggaagcaagcctcatcgatttccggtgctggtagacgaattcttgccgcggttatggggaacgcaagtctgtcgtgcctttgggaaaacgaataggaaggtgcctcttcgtttgcctggttccagccaccggacacgggttcgcaatggaatatcggtcggatgccttttacacgatttatggattatcgtaccagtcttcagctcgcctgaccctttatgcattgatattttttaattaatagagaattatgttgtggacttctgagttcaaacaatcgatgaagattgtattaaccaatcataatgacgttcacaaccgcaatttttctctattgtctgacaattctaacgcgtacaagcttgttgttgtcttttagccttgtactagatgcatcatttaccggatcgtgctggttgatgcacgataacgacgattaaggagagagcaatgaagccggtgtccgccaccaatgttcagctcaccataccgacctatgaggtaggtaagccggattctaacccgcaatttatagaaggtcgcgtataccagggttcgacgggtaaggtctacccctacccggtgattgaatccatcactgacgataaaaaagacaaagtctacaatgccgttaatctggaaaacgaatttctcaaagtcaccgtactgcctgaattgggcggacgcatccagtatgccactgataagaccaataactacgatttcgtttaccgaaatgacgtggtcaagcctgccttggtcggtcttttgggcccatggatttcaggcggcattgaattcaactggcctcagcaccatcgaccaacgacattcatgccggtcgattaccggctggtagagctggatcatgatggcaggggggtgcaatgccatgacgtggacagaattcatggcacagaagtagtcaccactattgccttgtatccggggaaatcctacattgagatatccgctgacctctataatggcacacccctgccccagagcttcttgtggtgggcgaaccctgccgtgccagtgaatgagcacaccaagaccgtaatgccgcctgacgttgttgctgtgatggatcatggcaagcgtgatgtcagccgttatcctattgcgacggggacgtactataagcatgactactcccagggtgtggatataagccgttacaagaacattcctgtacctaccagctatatggcggcacactccgatttcgattttgtcggcggttatgatttcaaggaggaagcaggcatccttcatgtggccgatcaccatatcagccccggtaagaagcaatggacttggggctctggcgatttcggtcatgcgtgggacaggaaccttactgacgccaacggcccgtatgtggagcttatgaccggcgtgttcactgataatcaacctgacttcacttggcttaagccgtatgagaccaagcatttcacccagtatttcatgccttatcggtccctgggtctggtcaagaacgcaaccctcgatgcggcagtgaatttggaatttggccctgccgatccgattgaggctgagcgggaatcagaaggggtcgatggcgccggcctccaggatgggcaaggacgctttaaggtttcagctacgtcaagacatgcagaagtcatcgtcaaggtggttggagacgacaatcaagtgctcgcggaaacaagagcagaaattggacctgaccatacatgcgaaggcttgttcaatactcaaggcaaaaagccctgggagatctcaatcagcgtcacggacgagcaagggagaagcctagtcgcttaccgaccgcttcgaccgaagataccaacaatcccctcaccggcaaaagcgccgagtgagccttccgctatggccaccaacgaggaacttttgctcacgggtcagcatttggagcaatatcggcatgccactagccgaccggatccgtattaccttgaaggccttaaacgcgatcccaacgataccagaatcaatgtggcctatggggaactgctgctaaggcggggggcatttgaagaagccagacagcatttcaagacgtcaatcaagcgacttactgagcataatcccaacccttatgacggccgggctttcacggatttgggccttgccgagttcttcctgggcaatgatcaggaagcttacgatgcctggtacaaggcaacctgggatgagacccaggccagccagggttattattacctggccatgatgtgcgcaaggacagctgagtgggcgcagggtttggcattcgtcaatcgtagtctggaatataatgccctcagttccaaggccctggcattgaaatccttcctcctgcgtcgtcaagggagggaacaggatgcgttagaaagtctcgacgagaatctgaagcacaacgcttttgacttcgtgtcaggtttcgaacggcatttgctgggagatagcgatgaggtgttttccttgatggggaatcggacctataactatttgaatctggctcgcacctatatgtcattcggcgcctacgaggaggcttgcgcggcgttgctgcggtcggatgaacaagatgccttggtgaattactatctggcctactgtgagcatcgtttgggtagacttgagcagtctgcgcggcatattcaaacagccgaaaagttgcgggggctatattgtttccccaatgcgcttgaagacatcttcgtcttgagggacgccattggtatgggagccaaccccagggccgcttattatctcggctgcctgtactatgacaaattgcagaccagtcgggcggtctccatgtgggaacggtcctgtgctgctgatccgtctttccccacggtccacaggaatctggctctcgcctattataacaagcttggccggaagcatgatgcccttgaacagatggaagaggccttccgccttgacgagtcggacgcgcgagtttttttggagttggatcaactgcatcaggcaatgggctggacctatctgcagcgtcgtgagctcttcgaaaatcatatgaccttggttgaatcccgtgatgacttatacgtcgagtatatggagattctcaatctgaccggttcttatgaacaagccttcaagcttatgtcaaagcggcatttccatccctgggaaggcggcgaaggaaaggtgaccgcccagtatcgtctttcgctgatcctcatagccctgcaagctatgaaggcgaaagattggcaattggcgcaagaaaaactcataatggcacagcgttaccctgaaaatttaggggaaggaaagctggaagggcagaaggacaacgatatccattacttcctgggcctggttaatcagcaactgaataaggacgaagaggcgactgccgaattcagaaaggcttccacaggtccgaatgaggtcaagggagctctgtactacaatgatcagccgtctgaaatgatcctgttccaaggacttgcccacctggctttgggtgaggctggccaggcgaatgcgcgtttctatcggctgttggattatggtgaacagcacctgaacgaaagtgaccatgttgatttctttgccgtttccctccctgatttccgggtgttcgaaagggactatggccttatgaaccacgtgcattgccagtaccttattgctctggcgaacctaggcatgggcaacgagaaagagtcagtttactggtttggacgggttctcgctgatgaccccactcatatgcaggccacggcattcatgaaagccataacggtggaccggttggccgcacagtttaggagcaaggaagcgaagtaaaagcgaaagcaattttctaatataatgcagcagttttcttatacgttcctcagtacttatttatagactggaactacgttgtttagttgtataatagagtactgaaaagagggcacgaagatgtgcgtatgagaaaactgctgtgtttgtttccagcagaatatcactataatcagggtcgcttatgtagtcagcggtattgaacagctgaacgtccagtaatcagaaacttgtgctttgccctctctgcaaatagttgaaagcgatgcctttcaactaagtgaggacagcaaaaaggaagaccgtcatcgttgacgtagggttggctgattctgtcaaatcaaacatctcaaaggagaagaatgacacattccatttctgcggcgagttctgtgaattctccgaaagatcgacaacccggcacaagtaacagacaccgacgtgattggcgcggatggaagtttatgggacctttcgcgctggctttcatgctggttttcgtcatcccgattatctacgccatttatatttctttctttgaaaggcggatggtaggaggaaccgttttcgttgggctaagcaactacaaacggctcttcgcggatggtaacttctggagttcagttgaacgtgtcagcgctttcacgctgattcaggctccgctctgcctgtttttggccgcgcttctggctttggcaattgactctatgaggttgcacggcacaaaattcttccgtatatccactttcctgccgtatgcggttccggctgtggtgtccacgctgatatggggtttcatgtacggagcgaaatacggtcttgtgggttcattcaatgcatggaccggcttacacatggacttgttggctcctaatattctgcttgtctcgattggcaatatcgtgacttgggaatatacgggctataacatgctgattttctattcctccttatccaccgtcccgcattctctttacgaggccgcagcaatcgatggggcgagtgagtggcaaatcgtacgccggattaagatgccggagttgcgtggcagtctggccattactgtgattttcagtattattggttccttccagctcttcaatgaaccgtcaatcatgcagaacatggtgccgggaaatactattaccagctactacacaccgaacatgtacgcctacagtctcagttttgcgggtaaccagtcgaattacgccgcggccttggccatcgtcatggcggtcatcactatggcgatcgcttacgttgtgcagctgaacagtctgaaggagcaaatgaaatgaccgctgatattatggatgaatcgccttcagcaattcgagctcgagagcggcagcgggcgaaacgcatagcgagggatgaacgggcggagcgcaagcgggcagcggaagctggattctccaacccttccaacccccgtcgttccctgccgctgacattggcgacaggtgtcttcgccgtctactgtctttttccttttgcgtatttgattatcaacgccaccaagacgcaaccggatttcacgtcaaccttcgggctttggtttggtcacacctttgcgctttgggacaacgtcgtcaccgtctttacatatgaagacggtattttcggacggtggctcctgaatacccttctctacgtagtggttggtgcaggtggggcaaccatcctggccattatgggtgggtatgccttggcgaagttcgttttccctggtcgtaaggctgttttcgccgtggttcttggttctatcagtgttcccggtatcgccttggcggttccgcagttcctcctgttcgcaaagatgggtttgaccaatactccctgggccatgatcttgcctagcctcattagtccatttggcctttaccttatgtggattttctcagaacaggcagtgccgacggagctcctggaatcggcgagggtagatggtgcgggtgagttcaggaccttcctgaccatcagtctgcctcttttggccccgggaatcgtgaccacggccttgttcgccatcgtagcgacctggaacaactattttctgccattgattatgttgaaggattccgaatggtatcccctgaccattggacttaatcagtggaagaatcaggccaatacagccggtggacatgcaatacagaatctggtcatcacagggtctctggttacggtgatccccctaatgatcgctttcctgattcttcaacggtactggcaatctggattggctgcaggagccgtcaaggaatagacgggcgccgacgatggcagcccggaaataacgaagcatattggtatatgaaacggagaagcagatgaccgaacagcatcggaagttcaagtggcctcaaccagtcaagggcgacagacccaggatttggttcggcggcgattacaaccccgatcaatggccggaggacgtttgggaaaaagatatggcctatatggtcaaggccggcgtcaacattgtctcgctggcgattttttcctgggccaagcttgagcccgaagagggtgtcttcgattttgcctggttggacaaggtcattgacatgcttgggagttccggcgttgcggtggatttggccacttccacggcttctccgccaatgtggctcacgcaggctcatcccgaggtgctttggcaggatgagcgtggagatgtctgctggcctggtgctcgtcagcattggaaacccacgagcccggtataccgcgagtatgccctgaccctttgccgtgccctggcgactcattacaaagacgaccctaccgtcgtagcttggcatgtgggcaacgagtatggttgccataatcgattcgactattccgatgatgccaagaacgctttccagctctggtgcaaagaacggtatggcaccattgagaacctaaacaaggcatgggggaccgctttctggtcacaggaacttaatgactttacccaaatcatcccgccccgtttcataggcaaggggaattttaccaaccctagtaggcttctggactttaagcggttcagctcggatgctctcaagagtttctatgaggcggaacgtgatgcccttgctgaaatcacgcctgacaagcctcttagcaccaacttcatgatcagtgccggcaacatgaccctagattatgatgactggggttatcaagtggactttgtttccaatgaccactacttcacgcctggtgaggcgcacctggatgaattggcgtattccggttcccttatcagtggggtggctcgtcgccatccctggctcctcatggagcaatcaaccggggctgtgaattggcggaccatcaacgagagaaaagaaccaggtcagctcatacgggattcattggtgcacttgggcatgggggcggatgggatctgcttcttccaatggcggcagtcccaagccggagcggagaagttccattcggccatgatttctcatgctggaaccgataccgaggttttcagggatacttgtgagcttggtcaggatttgcgagccttgaccgaggaaggtctgttggatgcgggagtggtcaaatctcccgtcgctgtggtattcgattaccagagtcagtgggctacagagcattcggccactccctcacagaacgtgcatcattggacagagcccttggattggttcagggcccttgccgatgtgggcgtgcgggcggatgtggtaccggtgcgtggagattgggacacatatgaggcggtggttctccccagcctttacatcctggatgccgacaactcccgcagagtccgtgactatgtggcggctggcggcaaaatcattgtgacctattacacaggtatcagcgaccaaaacgatcatatctggttggggggttatcccggctccattcgagatgtggtgggcgtccgatcggaagagttcgtgcccatgggcgatggcaaggatggggctctcgaccatctgaccctcagtaacggtgcgagggcccatgatattgctgattacatcacctcagtcgaggacacgacccgtgtgctcgtcacctatagtggtgatgatccttggtctggcatgattggggtaccggccatcactgttaacgcttttggaaaggggcaagccgcatatgtgggttgccgtctgggccgtgagaatcttgcgctaagccttcctgagctgtgcaaagctatggggattgcgttgcctgattcggctggatcaggcaatcttctgagacttgaacgcctgaaccaggagaccggccaggctttcgccttttactttaaccggactagagacaaggtcgcggcccagctggagggcgtgcctatcatttggtcccatgccgaggttgatgcttctaaggaaaccgcaatccttgaacccaacggggtagtggtcagcaaggggaccaggaagtgattggtgagtttggaacttatgcctgttacagggtatgaggccagcgtcaatgattgacgaaaagtaatcaaaagaaaagagtcacacaatgaaacatgctaagggtctgaagcgcttagtggcctgtgctggtgtagtggccatgttcctcggtgcctctgcctgcggcggcaagcaaagcgccacagacgagaacgtggaactaaatgtttgggcatgggagcccacactaaaggcggcgaccaaggaattcgagaagaagtacccgaacatcaagatcaaattgcagaatgccgggaccgcaaaggagcagtacacggcgctcgacaatgccttccaggctggcaaaggggctcctgacgtggcgcaaatcgaactttacgctttgagccaatatgccattaataatcgcctgaccgatttgagtgaccggacgcagggctattccaagttctataatccgggcacttggaattcggtcctggtcaacaagaagccttatgggttgcctttcggctctggcgccatggctttcttctacaacaaggacgtattcgataaggccggcgtcgacgcgactcagatcaagacctgggaccagtactatgaggccgccaagaagattcgttcggtcggttcatacattgccgccgattcaggcgattctggcttcttcgatgcgatgatttggcaagccaatggacacccctataagctttcagccgatggaaaggacctctccatcgatttggacaatgataagggcactcaggatttcatcaagtggtggcagaagatgattgatgaggacctggtcgacaccaagactgtcatctggactgaagattggaacaaaagtctgaacaacggcaagcttgcctccgctctgatagggtgctggattccaaccaccttggttaatgtggcccccgatcaagcgggcaagtggcgggttaccactatgccaacccaggatggttcaccggtcaattccaaccatggtggctcgtccttggctatcatgtcgtccagcaagaagaccgatgccgcgtataagtacatcgatttcatctcccggaatcaggccagcatcgatgcgcgtgtggcgggaggctccttccctgacgatgtgaaaaccactaagtcgcaaaagttcaaggacgcaaccacggtcaagaacgccaagggggaggatatcgcgtacttcggtggtcagaagtacaatgaggttctggcgaaggccgctggtgacgtaattccaggtcacgatacactgccgttcgaggtctatgcccggaccgtttttgccgatgatgtgggctccgcctacaccgacaaaaagatcaccttgaagcaaggcgtgtccgcttggcagaagcacctgaaagaatatggaaagcagcaaggcttcaacgtcaaataatcatttgatatcggctgatgccgttgccttgtattgataagatacagggcaacggcattcttgatactgtctgtgttgctccgtactgtgcccatgccttcttgcttaccgcttgactcgctgcagaggcatagcgttaaagggcgagaacaggttgcagcgtgaccgctgcttagactgtgtatcggggcaatgagggcagtgtcagcgataagaaccttggcgaaaaggaagagtgcattgtggcgaaacccgctgagcatggtattgacgcaagtgcttcggattttctgattcacaccccgtcggccatcgcccgcgccacttttttctaccccctacggatgggcgattttttctatgaacctggctacaggttggagcggagatctttcgacagctatttgatcatttatgtcgacagtggcaggttgttcttcgacctacccgagggttcttttgtggctgaagaggatagctttgtactgattaactgctacgaacgccatgcctatagcaccgatatcaggacgacggcacaatggcttcactttgatggtgtcatggcccagccctactacgaatacatcgtcagaaagttgggtaacgtttttatgctttcctccgagacgtacgctctggaacggatgagaaccatcaacaccctgttgaccgccgaaaatggatattccgaagccagaatgtccaaatgcatcaccgacctccttaccgagttcgcggatgaacagcctcgttcatttaagcgcaagcaaacggaggtggtggaagacacgattgcatacgtatccactcatctgtatgagccgcttaccatttccgagttggccgagcgtgtcttcctcagtgagtatcacttcatccgactcttcaagcaggaaaccggtatcacgccccatgcctacctggtggatgccaggattcatgcggtgcaatacctgctggtcaacagtctgatgtccattcgtcaaatctgccagcagtgtgggttcacttccgaatcatcgctgtgtgctgcattcaagaagagcgcaggtatgactccgatggaatatcgcagactgaaacaagggtgacgaatgctattcgagttaacacaggcatgtacgcgccttgtggcttcaatcgtgcatgtaacgatgaatagtagaagtaaaataatccagcttatagctgccgtgtgttgtggaccttgatgttttagtttccttggatgctgattaacggcgacgtataaggagagaagcgtcggtggtagggctctttccgaatggcacctgtgggcttataacatgcttatgtgatgcagcgtattacacaacatcggtggtgatgcggctctgttccctcttgcctgagccgccagagtgccccggatgcgattcgaacgcacgacaccttctttaggagagaagtgctctatcccctgagctaccggggcaacgaaacaccactgtagcacggggccaggccgtacgagcgtctcggcggggccgattgccggggcgggcgcggccgttcgctcagggctctgcaggtcgcgggtttcgctcacaatcagtaaggattgatactggctgacgggagcgagcggatggcggtgataggacgaattcctggggcgcgactgctattgacgctgctggcgcgcgtcttgaccgtcctcgccttaatcggcaccggggccaggctcctgcccagccggttcgccgactggcccttcttgccggagctggtctcgctgaccccctggttcgctctggtcgcggccctggctttggtcctcgccctgaccaccaggcgttggctgaccgctctactcgccctggccagtctgagcgcgggtgtgggctgggtctaccccttcttcgcagccgaccacgacttgcctaagcgggccatagtcgctggatcgtccgaacaaccgctcactgacgacgatgcggcgcgcgtgatgaccgttaacgtttacaagggccgcgccgacgcccaggccatagtccaggccgtccgggccaaccgggtggaggttttggccttgcaggagaccaccgatgagttcgtggacaggctgaacagggctggcatcaaggaagtcctgccctacgccaagatcgcctccgcggaccacaagtacggcaacggtctgtggtcggcctcgcccctgggctccccggcccgcgacgacgtgaactcatcggcctcgcaaatgccggccggcaccgtgactttcggcggcggccgggaggtccgcttcgtctgcgtgcacaccacgtcaccctcgccgggcgagtggggccagtggaagcgcagcttggacgagctgagcgccatgaaagcccacgtgcacaccacatatgtctttatgggcgacttcaacgccagctacgaccacgcccccttccgcgacttcctgggcgaccgcttccaggacgcggcccgctactcaggccacggtctgacgatgacctggccggccgaccgggcgaggacgccgctcttcacggccatcgaccacatcgttatagaccagggcatccaagcgggccagctgaagaccctgccgattccgggttccgaccaccgtgggctggtgggcagcatctgggtggggcggtgagaggctgaaaaccgagtcgctgagagcctgaggggacggaacgcaatggccgcctcccggtacaggaatcgcgctgtttactccaggttggactgggtgccggcggatgccccggcagaggcttgctcggtttgggccgcgtccagcttggcgcgcacctgtcccagcaactcctgggcccgcttggctaaggcctcgccgatttcccactggcgcatggaggcgtcgaggtccaggccgccggcctccagggcttgcaccgcctgaattaactggtcccgggcctgctcgtaggggagtttggcgatggtttcgcgctccttgtcggacagggtggaggccagggtctcctcgttgtctgcgttgctcttcgcggtgttctccgccatgattggctccttcgtgttgacgctgttcgtcttacttgctcttggtttggtcgtgtgcggtcgcgctaggggctggccgcggtcagccgttcagtcttcctgggatagggtggcggttttcgtggcctccagggctccccgcttgagggtgaccttgatggtggctccgtctgggatgactgaggcgtcggaggcgacggccccctgagccgtctgcaccaccgcgtagccccggtccagagtggattggggggagagggcggtcaaagaagactggagtttctccactgtgagcgaggcgtcgtccgcgatccttcgcaaggcaatgtccaggcgcaccttggcctcatccacgaatcgctggggcttgtccagcatcgtcagcggctgggtcaggctgggccggttggcgtagccctcaatcagcctggtctcgttgtccactaaggcccggatacgtgattcaatccgcatcctggcttcggcgataatgccctcttgctccatcacgtccggcaccacgcgtttggcggcgtcggtgggcgtggaggcgcgcaggtcggcggccaggtcgatcaaggtccaatcgtcctcgtggccgatcgcggacacgatcggcgtcctgcaggctgcggtggcgcgcaccacggactcgtcggagaaacccaacaggtcctcaaaggagccgccgccccgcgccacgatgatcacgtccacgctcgggtcggcgtccagtttctggatggccgccaccacctcgggcgggcactgggggccttgcacatgggcgtgaaccactgagaactcgatcgtgggccagcggaggcgggcgttggtgatcacatcgccctccgcccgggcttggggtgcgcaaatcagaccgattcgctgggggaattcgggcagccgcactttattctcggcatcgaaaagcccttcgcccttgagctgccggcgcagttgctcgatttgctctttgaggtcgccggtgcccacccgtcggatgtcgtccgccatgaagctcaagcgggtttgcttgacccacaggtcgggcttgccatgcaccaccacccggtcgccctggcggaagtcgcgggccttggcagcgaaggcgcggaagcccataacggacacggagatgtcctcgaagttgtcgcgcacggtcaggtaggcggacccggcccggcgggtgttgatctccacgatctgcccctccacccaggccccgggccagcgggccacggcatcgtggtacttctggctgagcacgctcaccggccaagggtcatcggcggtcgtgtccctggccaggcgaggaagttcgctcaaaggtttgggccggttgatcgaacccgctggcgcgcctccgccggcatcggcccagccgggcgcgaaagctgtgtgtatggccatatccgagcgcacatccgcctcctcatgtcggcacttcgtctagcttccacaatcccgcgggtcagggacaatcctggcgctgcgcacggcgctgcccgcgccatgtatgcgtccaggcggccttctcccttatgctattggcgtaggtgtatctgcctatgcgggactcgcatggtcaggcttggcgatagcatcttatgtatgaagccgttatgagcgggcgcggagggtcgggcgtccgtctttccaggcggcaggatgcggggttctggctttatgacgcaaggtctgacaggagcgcaacgggcggacggagcgcgggaggacccagttcccttgcgtttggggcttgacattggttccaccacggtcaaggccgtcgtcctgggtgcttcggaccgtttgagcgatgccttgttcaccgactatcgccgccaccatgccaacgtgcgtcagtgcgtggccgagctggtcaccgacatcaagctctccctggcccatcgcgacatggaagacagccccatcaggctggcgatcaccggttcgggcggcctggaactggcccggcagttgggagccgaattctcccaggaggtcatcgccgagacggaggcgatctccgccacctacccggaggccgatgtcatcatcgagctgggcggcgaggacgccaagatcacctacctgaagcccacgccggagcagcggatgaacggctcatgcgcggggggcactggcgcattcatcgaccagatggccaccctgctgaacacggacgcggctggtctgaacgagatggcctcacgctgccagaccatctacccgatcgcctcgcgctgcggggtcttcgccaagtccgacctccaacccttaatcaacgacggcgcagccaaggaggacctggccgcgtccatcttcaacgccgtggccacgcagaccatctccggcctggcttgcggccgtcctatacgtggcaacgtggtcttcctcggtggccctctcttcttcatgcccgagctgcggggggcgttcaaacgcctgctggaaggcaaagtcagctcctacatcaaccccgaggacgcccacttatacgtggcttacggggcggccttagtcgccgggcaggctggccaggcgtgcgatgatgagcaggaacggcttgtttccagcgattacacgcctgccaccgacgtgaatgatcccttcggtccggcctgggggctggacccggaggaggtcaagcgagctcggtcggccaacgcgagccccctggagaaaatggcccttgaggacgccaaggttgacggccgcagcacactcagcgtccaacccaagcaggcgggttcggacacggactcggccgcccgtgtggagagctcacgggccgccctggagcaggaggagggccatctcgacctgtccaccctggacgcggtgctctctgccctggagtccctcgattcgctcccttccatggcccgcacggtcgcgcccctcttcaaagacgccgaggaccgggaggctttcgaacgtcgccactcggccgaaaccatagccaccggcagtttggaaggggcgaaaggacctcacttcctggggattgacgccggttcgactacgatcaaagccgccttgatcaatgacgacaaaagcatcgtctggtccacttacggtgtgcatgaggagagcccgctgactgcggcggcgcagatcgtcaagcaggtgagcgccgcgttgcctgagggcgcttggatcgcccgcgcgtgctccacaggctatggggaaggcctgatttccgccggtctgcacgtggacgaaggcgtggtcgagacgatggcccactaccgggcggcggaggaggtcagccccggcgtcaccgccgtgattgacatcggcggccaggacatgaagtacatagcggtcaacgacggtgtgatcgactcgatttgcgtcaacgaggcctgctcggccggctgcggctccttcctgcagactttcgcccagtcgatgggcatcacgatccaggagttcacccagcaggcgctcgcctccaaggccccggtggacttgggttcgcgctgcactgtgttcatgaactcgtcggtcaagcaggctcagaaggagggcgcctcgcctgaggatatcgccgccggcttgtgctactcggtggtgcgcaacgccttgtacaaggtcatcaagctgcgcgatgcggacgcccttggcccgattgtggtcgtgcagggcggtaccttcctgaatgacgcggtcttgcgtgccttcgagcttctgaccggccgtcaggtggtacggcccaacatcgccggtctgatgggcgcttatggtgcggcgctgacggcccggatgcattgcgccgactatgagggggagggttcggaccgccctgtgagcagcctgctggccggcgaggagctcgaccacctgtcgatgaccaccacccatgacatctgcaagctctgccagaaccactgcaagctcacgatcaccgagttcgaggacggtggccgctacgtgaccggaaaccgttgcgagcggggcggcgacaagtccaaacagcgttccgaccggccgaatttgtacgatttcaagtacaagcgagccttcgcctaccgtcgtctgaccccggagaaggccactcgcggcgacatcggcatcccacgcgtgctcaacatgtacgaggattaccccttctggttcaccctcctcacctccctgggcttcagggtcatgatttcggggcgctccaaccatgagctcttcgaggagggcatggagtccatcgcatcggagaacatctgctatccggccaagctggtccacgggcatgtaaaatccttgctggacaagggcctcaagaccatcttctacccatgcgtcacctacgagcaggagctggttggcggcactgacaaccactacaactgcccgatagtggccaactacccaatcgtgatcgaggcgaacatggccgagctgaaccagcccggtgtacgcttcatggccccatatttcaacctgtccaaccgggagaagctggttgagcgcgtgaccaaggagttcgcctgggcgggagtcagggaggacgaggcgcgcgttgccgtgcaggaggccttccgcgaggacgcccgcttcaaggaggatgtgcgccaggagggcatgcgcgccctggcttacatgcgtgagcatgatgtacgcggcgtggtcctgtccggtcggccgtaccacgtggacccggaggtcaaccatggcattcccgagaccatctgctccctgggtatggcggtgttgtccgaggattcgatttgcgagctggacgccaaccacctgcccaagctcagcgattatgtgctctccgacgcgggggagcgggccctggcctctaacagcagccgggctcggcagttccgcaagacggtgcccgtaagcgggccggacaactccaagatgcccctgcgcgtgaccgaccagtgggcgtatcactcccggctttactcggccgcccgcttcgtctccgaatacccggatttgcagctagtgcagctggtctccttcggctgcggcgtggacgcgatcaccaccgaccaggtgcaagagatcctggccgacaaggacgacgtgtacacccagctgaaaatcgacgaggtgtcgaacttgggcgcggccaagattcgtctgcgttcgctcaaggcggctatggaggagcgggttcggcgcggcaagacccagggcggcgagggtactggggtggccactccggcggctcccgtcgagcgggacgcggggccgaaggatgaaggcaatattgtggaaactggtttcctggacgagggggacgctatcgctcataaccatgcggatcccgacggtttccgctccaccggcgcccgcaggatcagcgtccagcagtcccaggccgcgatcgcttccctggctcgcttcctggccctgcgcgaccgcagcggggaggggttgatcaggctccacccctacgggctcaccagccttagcgagcgtcgctcccgccaggactctcaaagcggtcagaggggaaagggtcccgattctccatggacgaccacagcgcgtcctgtgcaagctccgacccaggccttggataccggtgatgcggtctccgggcgccggtggcaggatgccgccgggtcgggggcggcccgcaagcccagcctgtccaagtacgctcatgtcaacgtattcaccaaggccatgggccacgattatacgatcgtgtgcccgcaaatgtcgccggtccacttctccctgctggaggcggtgttcgccagcggcaagtacaaggtcgagctgcttaagcacgccagcagcgaggacatcaacacaggcgtcaagtacgtcaacaacgacgcctgcttccccgcgatcatcgtggtcggtcagttggtcaacgccttcctgtccggccggttggacccgcacgggtgcgctgtgatcgtcacccagaccggaggcatgtgccgggccaccaactatttcgggctcctgcgcaaggctatggcggacgcgggctacggctacgtgccgatcatcaccctaagcgtccaagggttccggtccaacccgggcctcaaggtcacgccctccctcctgcaccgggcggtcaaggccttctacctgggcgacgccctcatcgaatgcctccttcgggtgcgcccctacgaggtcgagcccggttcggcgaaccggctctataagacttgggacacgatttgcaaggagaccctggagcaccacggatggtcagccacggctcagcgcgagtacgggcgtggtttcctgccgtattccagcctgatgaagcagatgatcgcggccttcgaccgcctgcccctgcgtcaggcggagcgcaagccccgcgtgggcgtggtgggcgagatcctggtcaagtaccacccggacgccaacaaccacgtggtcgatctgattgaggaccagggctgcgaggccgtgctgccgggcatctgtgacttcatggtcaacggcatgtccaacgcggagtggaacgaggagcgactgggcaccggcggccccattaagctcaagcggatggccctgagggcggcggacgcctaccgggcgccgatgatccaaggcttcaaggcctcgcacggcaagttcgacatccccagccacatcaccgatttacgggccaaggccgacacggtcacctccctgggcgtgcaggctggcgaaggctggctgctgaccggcgagatcatcgaactgatcgaggagggggcgcccaacattgtgtgcgcgcagcctttcgcctgcctgcctaaccatgtgacgggccgaggcatgttcggcaagatccgccgtaagtaccccgaggccaacatcgtctctatcgactacgatcccggcgcttccgaagccaaccagctcaaccgcatcaagctcatgattgccgccgccaagaagcgtgaggccacccagcacgaagaccccgccgcgcagcctgtgaatgacgaggccctggacgctttcctcgatgattcctcccaaccggcacccggccaggaatcagacaaggtcctggagacgatggaagtgcgctaagggcaaccggtgcgcgcatggaacctcggtgatgaagggtctcattgttcgttccggcggaagcatgagcggctgattggggtgggactcgacccgaagcggcggaaagcctcagcttctttctccttgggatatgggacccataaagcgtaaggcgaccccgcgtggcgtcggctgcccgccgcgccagttcccgcgcttacgaagcgttcaccggtaaaggtcccaggtgggggaggggtagatggcgcgctcgaaggcggaccattccttgaggtagtccatggggggctcgcgcagccagcggagctgaatgccgtccatggcctccagactcatgcgcacgtagggcttcatgtcgcgcttccagtccatgccttcgggcagcttccaatgggtttgcgagtaatgtttccagacgcgctcggcccggaatttgaaatagtcgtgcagggggtgggaggggtcgaaagactcggcttggagcaccatgaacagctggaccagctcgggttggctgacgttgtgcttgaccaggtagcgcaggtaggccgggaagtgcggggaggcagggtcggagccgggcagtccggtggtaagaaactcctcaggcgtgccgtagaccgcgtagacttccgtcactatcaaggagagcaggccctccttggagcccgcatagtgcaggacgcccggttgcgacatgcccaccgcgtcggccacgtccttaagggtgatgccgttgtagcccttctcgctcaccagccgggctgtggcgttggtgatttcctcgcggcgggcctgcggcgtcttgcgtactttcctggccatccctgcgcccccatcgtattcctgtcgccgccgtcgcatacccgtcagggcctgccggtgtgcccgcgaacctttcctgcgggccttaagccgcgttcttctttcccgttcatcgtaaccgtagccgttccccaggcagaccttcccaggccaggagtggcgttcaatcattcatttgacaaatttgttgaacgagtattagatttaaattatctaacggatggtagataacgaagtggttgcgatcctccgctcgctaggtacgtcaatgcagaccatggagaaggaaaggggtcgtcggatgaacgactctgcaataagaacggcttccgcccaggaacggctggcagcccaccaggccgcgatcgcggcagccgaaaaggacccgacgctttcgccggaaacgggaaaaccagtagataagaagaccatcatacgcttcggcttgagcttcctgcttttcggcgtcttctggatgtcgggcctgggcatagtcagcttcgtgctgctgcctgaacacctgaagcaggtgccgggcgtctcgcctgagtacctgattggtgtggtcaacgcctgcacggccgtggcctccctggtctccaatctgctgttcggtaacttctccgaccgctcccgttcccgttacgggcgtcgcacgccctgggtgctgggtggcgccgtgttgggtggcgtgacgctcttcctgaccggcatgacgaccaacccggtgctcctgaccatcgtctactgcctgtgcatgtttggtctgaactgcatgatcgcgcccctggtcgccgtcctgtccgaccgcgtgccctccggcgtgcgcggcaccctgtccgccttctacggcgccggctccacggtcggctcgccaatcggctccctgctgggcgccgcgttcgtctcccacatggtgtccggtttcgcgctcgcgggcctgctcatgttcctgggcggcatcgtgtccatcctgatcatgcccaaggagcagagcgccgactacctgcccaaggacagcggttcgctcatcgacgtcgtcaagtccttccagcctccccgtctgcacggcgcccatgacttttacaaggcgttcgtgggccgtctgtgcatgttgctgagctaccagatgatctccacctaccagatgtacatcgtggagaagtacgtggggcagaccgtgaaggaagcggccggtacgatcgccgtcatgtcggtcatcaccatgattgtcaccctggtcggttcgctggtctccggccccatctcggacgccatcggccgccgtaaggtgccggtcgtggtggcctccggtttgttcgccatcggtatcgccatgccatgggtcatgccctcggccatgggcatgtacctctacgccggcatcgccggtttcggctacggcgtctactcctcagtggaccaggctctgaacgtggatgtgctgcccagcaaggaccaggccggcaaggatttgggcattctcaacctgtccaccaccctgggccagatggcaggcccgctggtcatgtccgccattgtgctgcacttcggctacgcggccgctttcccgaccgccatcgtctcggcattggtcggctgcgtcttcatcatggccatcaggacggtcaagtgagtcgcaggacctggaaggtcaacgataatcaatgaatgaatgtcggcgccctcgtccatgtcgcatggtcgcggggacctgggcgccggagcactaataggaggaaacgcatgactcggacaatcgagtggatttcaagcaccccccagcgcaagctgtccgaagcggcgatcgagcccgtccctttggggtcatcggacgacatggagctgaccggtcgcggcctgcaggagctgcgtggatttggcggctgtttcaacgagttgggctggctacccctgcagcaagtgggtcaggaggagcgcgaaggcgtgatccgtgagctcttcagcccggacgaactcaacttctccttcaaccgcacgccggtggccgcgaacgacttcgccgactcctggtacagctacgacgagaccgagggcgactatgggctcaaggacttcagcgtggagcgcgatgagtccacgctgatcccttacatccgccaagcccagcgctaccagccgaatatgggcctgttcgccagcccctggagcccgcccacctggatgaagacctccaaggcctacaacttcgggagcatcgtcaccagcaccgagaacctggacgcctacgcccactatctgctgcgttacgtgcaggagtacgagcgtcgcggcatccacatcaaccagctgcacgtgcagaacgaggtcttcgccgatcagaagttcccctcctgcctgtggtcaagcgacgatctgcgcctgttcatccgtgactacctgggcccgctgttcgccaaggaggcgcccggcaccgacatcttcctgggcaccctgaacggtccggaggacatgaagttctcggcctcgggcatcgagctggagaactacagccgctttgtggacaatatcctcttcgacgatgactgccgccgctatatcaagggcatcggctaccagtgggccggccagcacgacatcgagcgcacccaccagtgctggcccgagatcgagctgatccagaccgagtccgagtgcggcatgggagagaattcctgggagtacgccgagtacgtcttctccctgatcaaccgctacttcaagtcaggcgccaccgcttacacttactggaacatggtccttggcgacggtctgagcacctggggctggaggcagaactccctgttcaccgtggattccacgacccacgaggtccggcgtaacccggagtactacgtgatgaggcacttctcccactacgtccagcccggcgcccggctgttggaaagccgggggcatttcggggccatgtcgatcgccttcgccaaccctgacgggagccgggtggtggtggcccagaacgcgctggagcggtccatgccgttctcctgcgccggaatcgaggggcaggacgtgcaggagggttcggggttcaaggccaccttggagccccgttcgttcaacacgttcgtaatcaaataaggcggtccgccggaccgcgggctgggtggattagcgtaaggcaaggggaaacagggcgatggagacaggtgaggcaatgaaggaaaccggaacgatgacggacaagccatccgctgggactgatggcaggccggccatgcaggtggaccgcatactgttcggcgcggcgtattacgacgagtacatgccggaggatcggatagagaccgatatgcggatgatggaggcggccggcatcaccacgatccgtatcgctgaatccacatggtccaccctggagccccagcccggagagttcgacttcacccatgtggaccgggccctggaggcggcgggccggcacggcatccaggtcatcgtgggcacacctacgtatgcggtgcccgcctggctggtgcacatgcatcctgacgtgctggcgcgcacgccccaagggcagcagacctacggggcgcggcagatcatggatatcgtcaacccggcctaccgctggtacggcgagcgggtcatccgcaccctcgtcgcccacgtggccgaccaccccagcgtgatcggctaccaggttgacaacgagaccaagtattacgattgcgtctcgcccgacatgcaggccctgttcgtcaagcacctgcgcaaggtcttccatgacgacctggacgccctcaaccgcgagttcggtctggactactggtccaaccgggtcgactcctggcaggacttccccgacgtgacggctacgatcaacggttccttggcggccgagttcgataagttccgccgctctctggtcagtgagtacctgtcctggcaggcggatatcgtgcgcgaatacgcccggcccgggcagttcgtgacccataatttcgacttcgagtggcggggctactcctacggggtccagcccgccgtggaccacttccaggccgccaaggcgctcgatatcgccggcgtggacatctaccatccaaccgaggacgatctgaccggcaaggaaatcgccttcggcggcgatatgacgcgctcgatcaagggcggcgccaactacctggtcttggagacggaggcccaggggcaaaacggctggctgccctaccccgggcagttgaggctccaagcatacagccatttggcttccggcgcggatggcgtgatgtactggcactggcattccatccacaactccttcgagacttactggaaggggctgctctctcacgatttggagcccaatcccacctacgaggaggccggggtgttcggccgtgaaatcgccgatccgcaggtgggcgagagcctgaggcacctgcgcaagcgcaaccgcgtggccatcatggtctccaacgaggccctgaccgccctgaactggttctccctggacaccggtttccccgggggcaccgagtacacttacaatgacgtggtccgccgggtctacgacgccctctttgagctcaacgtggaatgcgacttcgtcaactgcgacgccagcgctgacgagctttcccgatacgccatgatcgtgaccccggccctgtacagcaccccgggatacacgcttgaacgcctgcgggagtatgcgcggcagggcggcttcctcctgtccaccgtgcgctctttcgtggcggacgagtacctgaaagtctggcatgatcgggccccgcacatgcttgcggacgtgttcggcatgacctacaaccagttcacccgggccaaggaagtcggattgaccctggccgacggtctgggagccacggactccgccaaggagggcgccttcgcgcccggctgctgccaggccctgatcgagctgcttaaaccggatgcggacaccgaagtgctggctggctacgaccatccggtatggtcgtcctacgccgccataacccgtcaccggttcgggcagggccaggcggagtgggttggcagtctgctcgcgccgcaggcgatgaaagcggtgctggcccaagcggtcaaacgggcggggctgtggggcccgacccaggatctggcgggtcgcatcgccgtgcgccagggggttaacggccgaggcgagagcgtgacctatctgctcaactacagtcctcgaccggccgcgctggctgcccccagcgccggaaggttgctgctgggacctgacaaggggacccaggtggcggcaggggaggacctgaaggtaaacccctgggacctggccgtcatcgtgggtaccacgggctgagcgcggcaggagaccggtaacgggtacgaagaagcatacaagaaggatggagcgcacaatcatggaggacgagaccgcattggacggggcgccgtacaggaacccctcacttggcatagatgagcggttggcggacctgctggggcggatgaccctggaggaaaaggtgggccaggtgatgcagctggatgcccggggaggggtcgaaggacccatattggagcggcacgtgggctccctgctgcacgcctcggccgagcggctgcaggaggccagacggctggtggagcagacccgcctgcgcatcccgctgatcataggcgacgactgcatccatgggcactccttctttgaaggcgccaccatattcccggtccagctgggcatggcgaccaccttcgacactgagatggcaaggcgcatagcccgcgcagccgccgaggaggtctccaccaccggtatccattggaccttttcacccgtcttgtgcatagcccgtgacacccgatggggcagggtggacgagaccttcggcgaggacccctatctgatcggcgagatggggtccgccatggtgcgcggttaccagggtggttcggccatggaaggtgaactgccccgagatgcgatcctggccacggccaagcatttcgccggttattccgagacccagggcggccgcgacgcctccgaagccgacttgtcgcaccgtaagctgcgctcgtggttcctgccgccgttcgagcgcatggcccgggaaggttgcgcttcgttcatgatgggctatcagtccatcgacgggattccggtgaccatcaacgattggctgctgaaccaggtgctgcggggggagtggggttacagcggaaccctggtcaccgactgggacaatgtgggccgcatggtctgggagcagaaagtggagcccgactacacgcacgccgcggccgccgccgtcaaggccggcaacgacctgatcatgaacactcccggcttctacgagggcgccctggatgcgctctgccaggggctgctgtccgaggaggagctggaccaggccgtgagccgggtgctggcgctgaagttccgcctggggctctttgaggatccgcgtcttcccgacctggagcggcagcgggcggtcatcggctccgaggagcaccaggagctcaacctggaggcggcccgtgaatcggtggtgctgctcaagaacgacggcctgctgcccctgtctggcggcgatggaagcgcctcgggggcccggcgtatcgcagtcgtgggtcccctggccgacgacgcacagacccaactgggggactgggctggcggctcgggccagtgcgactggatcgacagccagccacggcggatgatcaccaccatcctggacggtctgcgcgagcaggtgccggacggttggcaggtggactacgcccctggagcccggattctgaacctggtggacgaccctgagggtcccacctacccggatggacagccccggcctaagatcgccgccccagcgcccgcggacccggaactgatcgcccaagctgtggaggtcgcccagcgttccgacgtggtgatcgccgtggtgggagacgtcatccagctggtgggcgagggatgctcgaccgccaccctggagctctacggcgaccagaaggacctcctggacgcgctcgccgccacgggcaagcccatggtcgtggtgctcatgtcgtccaagcccttgattctgccgcccagcggactcgcggcgcaggccatcctctggcaacccagccccggcatgaaaggcggacaggcgctggcggagattgtgctgggcctgaccgggccctcgggccgcctgccgatcaccttcccccgtcacgcaggccagctgcccgtctactacaaccaggtgcgcggccagcacggcaatcgttacgccgacctgacccaggacccgctctgggcattcggcgagggattgtcgtacaccaccttctcctatgggaagcctgaattggatggcccggcccaggtgggggccgacgacgtgctgcacctcagcctgccggtgaccaacagcggtgagcgccctggcaccgagctggtccagctctatgtgagcgacctggttacttcggtctcgtgggccgggcgcgagctcaagggcttccagcgggtggatttggagcctgggcagaccaagcgggtcgttttcgacctgcctgtctcagaatgcacgattgtggacgcatcaggcgaccgcgtcgtggagcctggcgagttccaggccttgctgggccactcctcgcggatggatgaccttcagtccgtcaccttcaccgtgcggtaaggagaccccccccccttagatgtagcccttccagagggggagggggaagaggacaggctcgcattccgcccacatggcttccaggtcctggccaggggcacgcagccaacgcagttgcaggccgtccatcatcgagaacccggcgcggatcaggctggcggcatccacatccttgggcagggaccagcggatgttcagcgcggtgtccacgatggtgcgttcgcgggcctggaagtattcgtgggccggatggtctggatccaaggcctcggtggtcagggtggagaacatatgcaccagcagcgggcggcgggcgttaatggcgaccgtctcccgccacatgcgcgcgatgagcggccggggctggctgagcgtgtggctgatcacctgggccgtttgcccgtcgtacaagtcgtccaggaccatctccagcaggccttccttggagcccacgtggtggagcacgccagccttggtcatgccgacttcgttggcgattgactggatggtggtgccgtagtaaccgcgcagggcgaaggaacggatggccgccagggtcacggcggcccgtccgtccatgtgttcgatgcccagttgcctggccagttcgcgcaccggcaggctgaatcccgcgcggtcggccccatccccagtcggggagcccgtcgtcggtccctctggttcgcccgcctgctgcgctgtatccatgaatccggtccttctcgtgccgccttgcccgctggtccgggtgcggtcagtgcccaagcgcgttctgccgcctgggttcgtgggtgttactgcgagtatatcgctataaggcgcttaccgaatggtaggtgtgggaagcgtgtgtgttggccttggctcggcgggtcgcaagtgatagagtacttaccaattggtaggtatctactgcaaaggagcgatgatgaccgatacaaacgcatcccggccccaacccgccttccccaaggcctcggacctgagcctggaggaaaaggccagcctgacctcgggaggcgacgcctggcacttgcagggcatcgaatccaagggcgtccccggctacatgatcactgacggcccccacggcctgcgcaagactgaggagaagaccggcgcggtcgacttgaacgagtccgtgcccgccacctgcttccctcccgctgctggcatggcctcctcctggaacccgcaactggtggaagaggtgggccgggccatgggccaggagtgcattcaggagcaggtggccgtcatcctggggccgggcgtcaacatcaagcgcaaccccctgggtgggcgttgcttcgaattctggtccgaagatcccttcctggccgggcatgaggctgtgggcatcgtctccggcgtgcagtcgcagggcgtgggcacttccctcaagcactttgccgtcaacaaccaggagaccgaccgcctgcgaatctccgcccgtgtctcccagcgggccctgcgcgagatctacctgccggcgttcgagtacatcgtcaagaccgcccagccctggacggtcatgtgcgcctacaaccagatcaacggagtccatgcctcccaggaccactggctgctgaccgacgtgctgcgcaaggagtggggctttacgggcatcgtgatgagcgactggggcgcggaccacgaccgcgtggcctccctgaacgctgggctcaatctggagatgcccccctcctacactgacgaccgggtggtgtccgccgcccgcgacggcagcctgcccgtggaccagttggacagcatggcccaaggcatgatcgacttggccgctaaggccgcgcccgccatgagccggaccgactaccgctacagcgtggacgagcacagggacgtggcccgccgagccgcgcgtgaatccgctgtattgctcaagaacgagggcgctctgctgcccctggacccgaacggcacggtggcggtcatcggcgagttcgcccgcactccgcgctaccagggcggcggctcctcccacatcaccccgaccgccgtctcctccttcctggacgcggcgggcgagcggggcgcgaaggtggacttcgcgccaggattcaccctggacgacgagccccaggacgagtcgctgaccagccaggccgtcgaatcagcccgtaaggccaagtccgttctgcttttcctgggtctgcccgagcaggaggagtccgagggcgccgaccgcaccaatctggacctgccagccaagcagctggacctgctcaaggcggtttcggcggtgaaccctcacgttgccgtggtgctctccaacggctcggtcgtctcgatcgccccctggcgcgaccaggcgcaggcgattctggaaggctggctgcttggccaagacggcggccgcgccttggctgacctgatttacggggactacagcccttcgggcaagctggcccagaccatcccgatggacctggctgacgatccgaccatgctcaactggcctggcgaggaggggcatgtggattacggcgaaggtgtgtacgtgggctaccgctactacgactccttccacaagccggtggcgtacccgttcggtttcggcctgtcttacgcgagcttcgagctctccgacgtgcatgtgaccgccaggcagggcaacaccgccacggtgagcgtgcgcgtgaccaacacctccgatcgggacgccgccgaaaccgtgcaggtctatgtggcgccaggcaaggcgaaagtcgcccgccccagccacgaactcaaggccttccgcaaggtcttcctcaaagcgggcgaaagccaggaaatcagcatcgaccttgacgagcgcgccttcgcgtactggtccgagacccacgccggatggcggattgaggccggtgactacggtgtcgaagtgggcacctccagccgcgacatcgcagccaccgtcacaatcagcctgcccggcgacggcaagcgcctgcccttgaccgagtggtcgactatggacgaatggcgggaggacccggtcggcggtccgatcatggaacggatggaggcattgggccgctccggcgagctgcctgaactgcccatcgacaacgcttcggccgctatcttcctggcctccatgccgattaactccctgttcgtactgatgggtgggaacggctccaagttgaccaactacctgttggataactacgcgcaggccacccacgccgcttaaggcgtgtgaccaagccagacggactaccggcggggctggggccagagcggtcccggccccgctggcgattggggccgccaaggtagtctagaatgagcaggcgtgacgtggctcatcgggccgccatcagtgaacagggaggtcgcacaagcatgggattcgtcaccatccgggacgtggcccgccaggccaaggtctccacggccgcggtctcgcaggtcctcaacggcaagggacgattctcggcggagacgaagaaggcggtgcgtcgagccgctcaggacctgggctacatccccgactcccgcgctcaagccatgcgttcggacagcacccaaatggtgggtctgctggtgcccgacctgcgcaatccctacttcgccgacctggtctcatccatggagaccatgctctatgagcacgggttcggcgctctgatcggcacgtccgccgagtcggtcaagcgccaggacgatttcatcatgcgcatcctgggccagcgcatcgatggggtcatcgcagtgccgcagggggcggactcctccggcatcgaggcgctggtcagccgcgagctgccgctggtcttcgtcgaccgccgcgtgccgggcatggatacggtgccctacgtggtttccgacccctactcgggcctgcgcgaggccctggagctcttgcgccgctacgggcatcgacgggtcgcctatgtggcccacccctccctgggctccttttcggtcaatgaacgcgcccaggccttccgctccctcgcgcccacctattgcgggcctgacgacagcgcggtcttttcgtgcgacgacagtgcggcgtccaggcagagtacgattgaccggatcttggccttcaaggccagcgcggtgattttcggatactcacccgacgcgataggctcaatcagcctcctgcgcggcctgggcatcgagataggctcgcgcatctcgctggtctcctttgatgacatcgatgcctttcgtctgctctcgccgcagatttccgtgatctcccagcaggtccaactgatgggccgccggggggtcgagatactgatggaccgcatcgcggcaggacggtccacgagctcccagcgctcccagttggtcagcatccccacggtcttcaagcggcgcgattcggtgggcaggctctcgtgatttggcctaggcgacgagcggcgggggtcgcggcatccatcgcggccgtccgtgcccgggctgtgggctcgattagtgagatgaaccgcccgtcgtcagggttggcttggccgagtgcatcaggttccgggggatgggcctggctggcatgcctgcgctacggctgccgctgccggttccgccctaaccggggaaggcgagctggacggaggattcgtcaccaccatcgagccggtttcagggcaggtccatgcgctgataaaggacgacgggctccaggcggggaaagtggcggtaatatgcgaaacacgacgagatagacagaggtgataaaacgttttatactggcggtgatgcagaaagattgtggcagtgagaccgtcgctgtaccgcagcggcgatggggtggttccgtcgcccagctgatgtaaacgagaataggtcttcggtctccacccctgccggcagccgcagcaggaggctccgaggactgatttcagatgcgctggttagtcgtttgcaagccttggttcttctcacttcccccttcggctgtatggttatgagatgaaactgcgcaagcaaggacgcacgagtgaaggtggtatcgaagataatgcaaggccaggaactgctagagcataaggatttcagcggcggctctgtcgtcatcttcggctcgatgaacgccgattacactgtgacgaccgaacgcctgccagctggtggcgagaccgtggtcggcggtccgctgaccatactgccgggtggcaaatcctccaaccaggccgctgcggtggcccgcttgggcgctcgggccgtgatgttgggcaagcttggcaccgacgccaacggcgacttcttggaatcccaactggtctccgccggcgtggacatgagctcggtcgttcgctgggacgggccttcgggcgccacggtcatcaccgtggacaagcatggggagaacacgatcgtcctgtcggcaggggcgaacgagcacgtcgaccccgcatacgtggactcggtccagagtcagctcgcacaaggctcggtgctgggcctgtgcctggagagcccgatggaggcggtcacccgcgccgctgagatcgcccaccaggccgggttgaccgtcgttttgaacgactcgcccttccaaggcctcctgcccgctgagctgatcgcgaatgtggacctgctgctggtcaatgagcacgagatgtggcagctgattcgccacgaaggcgatcagatgccggtcctgtccggcgagggctggtggaagcggttggactgggccgagatcgcctcccgcctgaagggcgtgggcttcgagtccgtaatcgtgacgctcgggtcggctggctccatggtcttggaggatggttcggcggagcatgtggacgcggtttcggtcaaggccgtggacacaaccggctgcggcgactccttcatgggcgcggtcctggcgggcctggccaccggctccagcctgttggattcagccaagatggccgcttacgtgtccgcgtacgccgccaccggccgtggagcgcaggcttcgtacggtaacctggagcaggtgcgcgcctatttcgcccagggtggccgctgagcgcccggcgcagcgcgtccgctccttggaggggttgggatgtttgttggccgccggccgtgttaggatgaatcctcacaagggcagtgatccgtcatcagcggggagccttcggaagaacgatggcgctaggtggcacgaaccggccggcgttatccagtagaaccgacgggtggggtccgcaaatccccctatgagtggtcgtgcaagcgggtttcgagcccggtgcgcggcaagcgaggtggtaccgcgcaggcggctggcagcagtccctccgtcctcggccagtaagagcaacttagggccgaggagcgtgcgcggtgagccaatccacgagtgaaggcgggaacagtagtcagcgggcggcatcagtctacccgaaagcggtcgaagggggagccgccgaccgcgtgggtcccagcccgtccttccctgatatggaggaaggcgtcctggagtactgggaccgtgacgacagcttccgcaaatccgtggacgcccgcccctccggcgaccacagccagaacgagttcgtcttcttcgacggcccgcccttcgccaacggcctgcctcactacggccacctgctcactggctacgccaaagacgtgattccccgctaccagaccatgaaaggccgcaaggtcaagcgcgtcttcggctgggacacccatggcctgcccgccgagctggaggcccagaaggagctgggcatcgagtcggtggaccagatcgagcagatgggcatcgagaagttcaacgacgcttgccgcgcctcggtcctgaagtacacccaggagtggaaggactacgtgcaccgtcaggcacggtgggtggattttgaccacggctacaagacgctcgacatcccttacatggaatcggtcatgtgggccttcaaacagctctacaacaagggcctggcctaccagggctaccgcgtgctgccttactgccccaaggaccgcacgcccctgtccgcccacgagctgcgcatggacgcggacgtttaccaggaccggcaggacaccaccgtgtccgtggccgtccgcctgcgcgacgaggacgacgcctacgccgtcttctggaccaccacgccttggacggttcccaccaacttctcaattgtggtaggcgcggacatcgactacgtcgaggtgcagccggtcgagggcaagttcgctggcaagaagttctacctgggccgcgacctgcttggcaactacgacaaggagctgggggaggggtataaggtcctgcgggagctcaagggctccgacatggtgggttggcgctactggccggtcttcccctacttcgccggcgaccaggccgtggccgagggcggtgtgcccggggccaacgcctaccagattttcaccgccgactatgtggacaccgctgaaggcaccggcctggtccaccaagccccctacggcgaagacgatatgaacacgctcaacgagcacggcatccattccaccgacgtgctggacgccggctgcaggttcaccgccgcctgccccgactacgagggcgagtacgtgttcgacgcgaacaagcccatcctgcgcaacctgcgcgccggcgacggtcccctggctcgcgtgcccgaggaccaccgggccctgctcttccaggagaagtcctacgtgcactcctacccgcactgctggcgctgcggcactccgctgatttacaagccggtctcctcctggttcgtctcggtcactaagatcaaggaccagatgctggacctgaaccagcaaatcaactggattcccagcaacgtgaaggatgggcagttcggtaagtggctggccaatgcccgggactggtccatctcccgcaaccgcttctggggttcgcccatccctgtgtgggtctcggacgacccgacccacccgcgcgtggacgtatatgggtccctggacgagctcaagcgggacttcggcgattacccacgcgacggcaagggcgagatcaacatgcaccggccgtacatcgaccgtctgacccggcccaacccggacgaccctagcggcaagtccaccatgcgccgaatcaccgacgtgatggactgctggttcgagtccggatccatgcccttcgcccagttccactacccctttgagaacaaggagtacttcgagcagcatttcccggcggactacgtggtggagtacatcgggcagacccgcggatggttctacgtgctgcatgtgatggcgacggccctgttcggcaagcccgccttcaagaacgtcatctgccacggcatcgtcctgggcgacgacgggcagaagatgagcaagcacctgcgcaactacccggatgtcaacggcgtgttcaacgactacggttccgacgccatgcgctggttcctcatgagctcgcccatcctgcgcggcggcaacctgatcgtgaccgccaaaggcatccgcgatacggtccgccaagtcatgctgccgatctggagctcgtactacttctacaccctctatgccaacgcggccaacgggggagctggatacgacgcccatcggctgctgcctgaggaggcggacggcctggcggccatggaccgctacctgctggcggcctgccgccggttggtcgagggagtggagcgctcgctgaacgatttcgccatcgccgacgcctgcgctgaggccagcgagttcatcgacctgctgaccaactggtacatccgcaacaaccgtgaccgcttctggcaggaggacaagcaggccttcaacaccctgtacaccgtcctcgaggtcttcactcgggtcatcgcgcccctggcccctatggaggccgaggaggtttggcggggcctgaccggcggcgagtcggttcatctggccgactggccgttcgtagcggatgaagccactggtgagcccaccgagctgggcctggttttgaaggccgacccagggctcctgaccgctatggagaaggtgcgcgaaattgtttcctccgtactctccttgcgtaagtccgagcggattcgcgtccgccaacccttggctcgcctggctgtgattgtggaggcgccggaggcggtcagcccctacgaggatgtgctcaagtcggagctcaatgtcaaagccatcgacttctctacgctcgcccaagccgagtcgcgcggactgcggctggtccaggagctcaaggtcaatgcgcgtgctgccggccctcgcctgggcaagcaggttcaggaggtcatcaaggcgtccaaggccggtgattggcggcagaatggcggccaggtggtcgcggtgacccccgctggcgatgtacccctggaaccggctgagtacgagctgaccaaccgtgtggaggagggcgaaggcgagggcgtcggctccaaggcttcggcggccctgcctaccggtggtttcgtgattctcgatacccagttgagcgaggaactcgaggccgagggctatgcgcgcgatttgatccgcgaggtccaggatgctcgtaaggccgccgggctcgacatcgccgaccggatcagcctgaccctgaccttgcccacggcggaagcttccaaggcaagccggttcgagtccttgatcgcctccgaaaccctggccaccagcgtggccatcgagtccagcgactccgtccaggagccccaggtccaggtaaccaaggcctgattccagacggcccaagagagtcccgcaggtgctcccagccggcgggactctcttgggccgtcctgagaggtagtatggggcgcacgtagcgcgcgatacggcgcacacctgaaacagttaaggaagacggaccgctgggtcgtccggcctgtaggctcaggcgttaaaggcgtacttatccatccgcccgaaggcctctttgacccggctcaacggcagggccaggttgacgcggatggcgcaggggtgctggaacatgcggccatcctgcacggcgacgccgacatcccacaggcgcttctccaaatcgtccaagctggtccggtgtctctcgcaccacttggtgcagtccagaaaaagcatgtaggtgccctccggcttggaggcttctaccccgtcgaaatgccgtgctatgtagtcgcaggcgtagtccacgttggcggtcaaggtctggcacagctcgtccacccactcgtagccttccggctggtaggcgccgatcagggcgtgcatggagagcacgttcatgtcgttgtagtgggacttggagtccttggccagcacacggtcgcgcaggtacttgttgtagatgatgtggtatgagccgactaacccggccagattgaaggtcttggaaggcgcgtacatggcggcgacgcgattgcgggcgtcgtccgagacggactgggtcggggtgtgcttgtggccgccgatcatgatatcagaccaaatctcgtcggagacgaccacgcagtcgttggcccggtaaacctccatggcttgtgtgatctcctccggctcccagacccgcccgcaggggttgtgggggttgcagaagatggccacatggatgttgttctccttgagtttcgcgtccatgtcagcgtaatccatgcgccacacgccccctgaatccttcttgagcggggagtggacgatacgcaagccgttgttcgagcaagcgccggtgaacccgatgtaggtgggggagtggaccaagaccgggtccccgggggacgcgaaggccgtcagggtggagatgacaccgcccaggacgccgttctcgtagccgatgtgctcccggctcaaaccggtgactccgttgcggcgggactgccagcggatgattgagtcgaaatactcgtccgtgggcgcgaagtagccgtaagcggggtgcttggctctctcgatgatcgcctgggggatggtgggaacagtcgggaagttcatgtccgccacccacatggggatgacgtcgaaaccctctttgggcggtttgggggcggatccctggcctaggccgtcaaccgagatcgcgtccttgccgtgcctgtccatgatcgatgtgaaatcatacttcatgctccaccgtcctttccgccgccccgagtggagcccagccagcggcattgctcgccttcaggaaccaaccttagcgctgacctcgtccaaggcgcgcgtctcgtccgcggacaggtccaactcagcggcggccagcagggccgggagttgctcgggaatgcgggcggaggcgatgggcgcggcgacttgcgggcgtgccttgagccaagccagggctaccgtcgccaattccacgccgcgcgcgctggcgattcgatccagctcggcgaccacgtccaggccagcgggcgtgaagtagtccttgaccatgccttcgcgctgcctgcccttcaggtcgtccatagtgcggtatttgccggtcaggaagccagcggccagtgagaagtaggagaagaccgccaggttctcatctcgcgccacttccatcagcccgtcctcgtagtccttgcggtgcaccaggttgtactggggttccagggccaccggcgctgtcagaccgttctccttggcgatgcggaaccactcgcggatgcgctcgggcgtgtagttggacaggccgatggctcggatcttgccctccttgaccagcttgtcgaaggccgcggccgtctcctccaagggggtctgctcatcgtcgaagtgggcgtagtagaggtcgatcacgtccacgcccaggcgcagcagggattcctcggccgctgcttgcacattcttggccgatagcccttgatactgggggtgctggctgaccttgctggccaccatgacctggtcgcgcttgccggaaagggccagccaacggcccagcacgatctcggattcaccgcctgagtggcccggagcccatgccgaatacacatccgccgtgtcgatcaggttgccgcccgcgtccgcataagcgtccaggacccgccttgaatcagcttcggaactggtccagccgaaggtgttaccgccaaggaccagtgggaagacctccctgtcgttgatgcgcgccatcgctgcctgcctttcccgcgccctcgcaaaccgggtgccggcctggggcgctgatcatcgttcattgccgtttcgctttcgattgtgctcgcctggtctgacttcgcgcttcctgcgcaaccggcgtggccccggcctggcggcgcgaataggtggggcatgggtcgtggcggggttttgcggataagcggaaggcggaaccttccggtctcaggcctgtcctgcgctcggaaggcggtcgtggactgtgcgttccttgcgctgctgccgagcattgtgcttccgggggtcatgctgttcgtggtgcccgactagcgggcgtttgatgggatgctctggtgagtcccgttggatggtcgccaaagtcagtccggtcgttaaccggcttaaggccgaaacggtcaccggggcccaggggaaccacgacgggcctttgattcgggctaagtcggctgtggacccggttgaggccgctcggcatgaggagaaaactaacatccggtggtcacggcagcctccccaggttggaatcaaggcgcgggccacctcgccgccgagaagccagcctgcagggcggggccatgccaagccggacccgtgcgtccgcggaggggcctctcccacgagccccgcctctggtcggggccctgcgcccctatcgtgcgttttcctttgcctggggcctatgggagaatgatcgcaccgggtcggccgctgaccgaccggacgcgccggaagcgccggaagggtgagttcatgctgctgattaaggatatctctaaggaatactgtaccgggggactgacccaaaaagccctggacggggtgagcctgaacctgcgggacagcgagttcgtggcggtcttggggccgtccgggtcgggcaagaccaccctgcttaacgtcatcggcggcctggaccgctgcgattcgggcgatttggtgattaatggagtctccaccaagcgttacaaggaccgggattgggactcctaccgcaaccatacggtcggtttcgtcttccagtcctataatctgatccctcaccagtccatcatctcgaacgtcgagttggcgctgaccatctcaggcgtgcctcgcgccgaacgccggggacgggccaggcaggccctggaacaggtggggttgggcgatcacctggacaagcggcccaaccagttgtccggcgggcagatgcagcgggtggcgatcgcccgcgccttggttaacgacccttcgatagtgctcgccgacgagccgaccggcgccctggattcgcagacttcggtgcagataatggatttactcaagcaagtggccaaggatcggttagtggtcatggtgacccacaacccggaactggcccgcgagtacgccacccgcatcgtcgagctgcacgacggctccatcgtgtccgattccgaccccctgcagatcgaaggctcggggctcaagcgggcccgccaccgcaagatgggcaaggcctccatgtctctgggcacttccctggccctgtccttcaataacttgcgctccaagaaggcgcggaccttcctgacctccttcgctgggtcgattggcatcattggcatagcgctgattctcgccgtgtccactggggtccatgcatatatcgataaagtccaggaagacacgatgaccgcctacccgatctccatccaggagcagtctttcgacttgaacaagatcgtcggctcctcccaggagggcgcccaatccaaacaggccggcaagggcgcaggcgacgccatctacccggacgattcggccatcacctccgcatccgccctgacctcctcgatctcgaccaacaacctgtccgccttcaagcaatacctggacaaccccaagagcgagattcgctcccacataggccgggttggcatgcagtactcctacgatgcaaaattctcggtctatgaccacgaccccaagggcacgctggtctccgcctccggggtcacaatcggcggtcagggcggtggcatggcatcacagatggcctccatgaaccctaattcaagcgatccctcacaggtgcagtccatgcagatggcggctttgaccggtaaggcccaggccaagtcatccccgtcctccttcaccgagatcatgcccggacaagacgaggcgcgcgccccgatcggccgcgtgattcaagacaactaccaggtgctcaaaggctcctggcccaaagacaaggaccaggtggtgctggtcctggactcgaacgaccgcatccctttggccaccctgtacgagctggggctgaagccggcgggcgactacaacgacatgatggccaagctcaataacgggcagaaggtcaagaccgacacggctaagctcgattacgatcaagccatgaagcagagcctggacctggtgcccgcctccgaccagtacgtgcaggacgcggacggccactaccggtacgtgggcgacgatgccggcgaggtggccaaactggccgagaaagccctgaaactcaagattgtgggcatcgtcaagccggtccacaaggcatcggccacgccgctgccagccggggtgggctacccgcgtgccttgaccgattacctgattgattacgcggccaagagcccggtcgtctccgcccaacaggccgaccgggagcacaatgcgctgaacggtctggctttcagcgcccctgacgatggggccaaggctcagcaagcgaaggattacgtggcttccctggatcaagtctccaaggcggcgatggggacggctgtgatgagctcggggcagtccgggcaggctggccaggtgcaaggccaggtggcagggcagtcaggtgctcaggggcagacccgggcccagggcagggacgggcaggccgtggccggtacgccagcagcccagcaggcagctcggcaagccgccgccgcagcctccttcgaccgctacatggccacggccggcaccgataagctggtctccatctacgagcagtacgtgcgcccccaagtgggctcctacaaggacaacatgacatccttcggcctcatcagccgctccgcaccgtcctcaatcaagatctacgccgactccttcgaggccaagcaggccatcaccgacgcgatcaacagctacaacgaccgagccaaaaaggcggacaaaatcacttataccgactatgtggggctgatgatgagctcggtgacgaccattatcaacgtgatctccggcgttctcatcgccttcgtctcggtctcgctgatcgtctcctcgatcatgatcggcatcatcacctacatctcggtgttggagcggaccaaggagattgggatcctacgggctatgggggcgtccaagcgcaacgtctcccaggtgttcgacgcggagaccggcatcatcggcctgctctccggcatattgggcgtgggggtgaccctcttgctgctcatacccggcaacgcgctgattcaccgcttgatgggcaccagcgaggtcaatgccttcctgccggtccgggcgggcgtgatcctagtggtcttgagcgtgctgttgaccctgctgggcggactcataccagccaggaaagccgccaagcaagacccagccacggccctgcgcaccgagtaggggcgtccggcggcgcggcaggctcagctttcgaggaagcctggaatcgcggcgccgtcggcgtaacccttgcggtacatgcgctccatgccctcctggttgcggttgagcgtgttcaatccgcacaactcgtcgggcgcgacgatcagggccttgccctggccctcgagttcgtgggcaaagtccagctgttcgttgtaggtacggtagcggttcctcaggctttcggccgcattcgggtaggtgcgctccaggaaccgggcgggtagggagtcgggcttgggggagcggtggaagtccctctggcgggtgagcaccacgaccaccttgtcggccccgtcgtccagcgcacgttgcactgggatggggtcggccatgccgccgtcgtagtaaggctcaccgttgaccatgtaaggctggttggccaccggcaccgaggacgaggccttcatgatcgagtagtcgtcttggtggatgtccctcttgtcgaagtaacggggctttccagtcagggcatccatggccacgaccgtgaattcggttgggttcgccgccagggccgggtagtccagggggtattcgccatcggagttggacagtgtgctgtacacgtaatccaggttcgcgaagttgcggcttttgacgaagttggagggggaggcgtattccttccgcgccgagtagacggagtagaagcggtaggtgcggcccggctggcctgccaagtaggaggaaaggttggctgaaccggccgataccccatagcagtggtcgaacgtcaagcccaggtccatgatccgatccaagacccctgccgcgtacacacccctgaaaccgccgcccacgtcgatgatcgccgtgcgatgagcacccatgccggcccctttcctcgttccttgtgtcttagcttatcctgcggttccggtcctggctggaggcccgcgccgttctcctcgttacgcggctttcccttccggtcgggctgaccatgcaacaacgccccaagcatatgcgcccgcttgggacaaaccccgactcaagacaggcgcttgaagagttggcgcgacagggactccagccgaggcgatgggtcggagttgccgattgccactcggccgcgactcgtggcctggttgagcgcgccgcgctcttccagcaaatcacgcaggtggcgggccgtgccttcattaccgtcgacgatggccaccgaggacgggcagtagcgctcgaagttgcgccggtaaaagacgaagtgggtgcagcccagcacaatcgaatccacctgggtcaaatcatagccaccgaagtaacggtccagggcctggcggatggcgtccgggtcgtccaagcggccggactccacgattgtcaccaggtcggggcagggctgggtcatgatggtgtggtcggcttggaagcgggccatgagacgggcgaatttgtcttccttcaacgtcagcggggtggctgcgacgatgattcgctggggacggccgccgcctcggtcgcaggctagtttcaaggccggctccatgccgacgaccggtaccttgtagcgcttgcgcaggtcgtcgacgcacacggaagtggccgtgttgcaggcgatgacgatggccttggctccctgatccagcaagtggtccccgatggtgaagcagcgctcgcgcaccgcttcggggctcttgatgccgtagggggcgtgggccgaatctccgtagaagaggatgtcctcgctgggcaggagcgcgtgaacggcggccgcgacggtcaggccccccaagcccgagtcgaagatgccgataggcgcctcgcgatccatgccaatcctccctgccgtggtgagctcatgcctgcccaagagcctactcctgcgtccggtcggatgacagggccggatgatcctgtgcgctcagaggaaaacggctgcaggcgggtcgtcaaggtgggggagcttctgggttggggcctgcgccgactgggtagggatgggcctggattcgctgcggtgcggcttcggcgcagctgggttcggactgcgcgcgatcggattgcctagaggagggcggagccgctcttccaggcaatcagcgcgaccaaagcagcgacccaaaccgcgtcgaccatcagatcgaagcccagccggtagtacttgcgcagggagcgggccaggccaggccagggcccatcggtcctgggcagggcttggacggtgaccgtgctgtgactgaaggccatgaactgcatggtgctggcggccatcagggacaggcaccaggggcacagggccttgatgacgaacattgactggctcagaagccagtaggcgtaggcgagcgcggtcagggagcccaaccaggtgcagcgggtcagccaggccggttgccggcacccggccaggccgaccaccgccaaagtggtgaataccgactcggcggcgatgccgagaaaggcgttcggaagactcagggagccgaaccgtaccagctccgattgccaggagagggccaccgtggagcatgagacggtggcgttgacatcgcagtccagtttgatgcccggatgcctggccagttgcagggtctcggccgccagggcgaaggaggcgaacaaggcggccgccgaggccagcagggcgatcaggtaggtccagatcctgccctgccgccaaccagcgggctccaaggcccggtcttgtgcgttcatgacccgctcctcaccgcccgttcgagccgtccccggttgcgggcggcggtcaggggaaaagatgaaagtgaatggaaagcagcatacgatgaagctatgaccaacgaagctatgaggcatgcgctgagcgaatacggtttgacccatgtgggctcaggtcccgaatccggaccgggatccgcggggaagagggaggcgggcgaaggcgccggctgggacttgcactgtcacacggtcttctccgacggaaccgagccccccgagcagctggtgttccaagctcggaccttaggcctggagggcgtggccatcactgaccacgacacgacccaaggctggtcggcttcggccgctgcggcccgctcccaaggttttcctgttctgcctggcaccgagattaccgctgatgatgatggcgtttcggtccacctgctcgcttacggctacgatcctgatgacgagtcgctttctaggctcttccggatgacccgccaggcgcgtttggaacgggcgcgcaagatggtcgaggctatgagcagggactttcccatcacctgggacagcgtgttggtccaggtcaaggagggcgggcgcacgacggtgggccgaccccacatagccgacgcgctcgtggccgccggggtctaccgcacccggtccgaggccttccaaggagcatgctcctcgcgcagcccctactatcggcccacgccttcgcccagtgccccccaggcggtcgaagcggtcaaagcggcggggggagtggcggtcgtcgcgcacccaggcgcgaccaagcgcaacgccgtcctgctctccgaccagcaaatcgagcggctggcggccttgggactcgacggtctggaagtttggcatcgggacaattcgatggctcagcgcgaccgattgctagggctggcccgtcgtctggggctgctggtcaccggaggctctgactggcacggggctggcaaacccaaccggttgggtgagcacacgacggatcggagcaccgtggaaacgatcatcgcccgctccgcgctcggttgaatgcgcaagtgcggggcgggcgatggcggtagggtccgcgcgctgacgaggcctccacggcagagcgcggtttagagggcgccgaagccgaccgggcgggctgtgtcggagccgatgattgcgtagcctagggctccggcgggtacgatgacgtgtcggcccttatcgtccaccaggtcgattgactcattggttttgagcgcctcttggatgctgtcggcgacttcgtccgcctgcgcgtcggtggagaaggttacgggccgggccacgttcctgatgccgaattcgatgtccatcttgcctcttcctcttgagttaggcccgtaatcacttgattgacgggcctttggtttccattattcgcctcgggcgccggttacgccttaagcgtccgaccgttcgctggagcgttcgccctcggctggctttgcatccgaagctgccgctgggcgccgttcctggctgtcgtcgcccgacctgtcgggatgctcgccgtcggtcgcgtcatcggagccggtgccagccaggcccactgaacgggtggtggactgcccggctgggttgctttgctcgatgacgatggtcggcgcttcctgctcctcgccggagcggtcgttcttatgcgcgtgctcggaagcggcggcgttccaaccatcgccgccgttggaatcgttgcctcccgcggcgctggcgctgtcgatagcgccgtctttgccgctcatgttgtcgctcttgtgggtgatttctgtctcctggctgtggcgtttccgctcttccagccggtgggcgcgctcggcctgggcatgagccaactcccgcattcgtgacaggtcgatcgcttcggtgcgcgtgttggtcgggccgtcctcacgggcctcgtcgtcggaccggggctggatgctgtggcggccgtgggaggagtcctcgctcggttcttgaggcagtgtggtgggcctgcggtggctgctggtcatgtccggcagggtagggggacgcaccgcggcgtggcggcctgtgggagcgttcacaagggcgccatcctggccttccgccggacggcggtagacgggacggacgacggtggcgtcgtcctccacggatggcgtggtcttgaccggggcggggccgctgtccgtcgcagggtcggccggattggcctggtcagcgtccagaagggcgccaatggtcaccgtggagggtgcatcgtccatgtcctcgccatggccgccaccgcgctcggggagttgcccggcagtcgcgggactgtacgtcttgggcaggctgtcggccaattgctgggccaaacgctccacctgggccttgaagcggatgattcggtcgttgtccgcttgctccagagccaggatgaagtcgcccacttgctccatctgcagccagaggttggcgcgcagcatgatcaagtcgtcaaggcgcgatcccatcatccgcccgtaagcggagatgaccgcgtcgcggcccgcctggtccagcttggcgaaggtccaggccaagtcgcgagcagggtcgttgacctgcatgttctgccagttgtggacggcgctgaggcccgagttggagaagagcaagtccccgtcggcgaacccgccgtggaccatgcaggtgtcgaaggaccacaagccttcggtgcggacgatacgcgaccaggaatcggtgatttcgcgcggcacatggcctgccttacgcaggctggcgatccaagacttgagctggtcggcgatttggtcggtgctgtaggcggggtagaagcgctcgcgcagggcgcgcgggtcgatccgatgaatggcgccgatagcggtgcccaccgccgagcactcctcgttggtcagcaacttcaagctctgggtgtgaccgggtgcgtgggtcatgattgccactgccacatcgccggttggccccttggggttggccccgttctcgtagcggaccacctgctccacaccgaagcccagggcgcgtaccccccgcacgtcctccagggcctccgccgctttcacccgcttgttcagcctgatcttgccctgctcgctgcttgtggcccagatgtcgtacaggcggccggaggcgttctgcacaatggcgcagtcaatcccctccgcctcgtcttgtgggctggcttggtcggacgcccgagcgcctgtgaaataggcttcgggcatgaccgcagaggccagggctacgagggttaacttcgttcgttccgtcacgcttccagcctaatacaaacggtgcctttgtcggtcgggtgcccgtgtccgcgctcgctacaccgtcgcgccgggcttatccaccgcaaggtccgggcttggagcgcttactcacatacgcacatcgcgcagcttggccttgggcgaattggccgctgggtggaggtgatggggcacaatgggggtgtgaacgaacgacagcaggctgagcggatcctcgacgggctggacgaggagcagacgcgggcggcgagggccgtggacgggccggtgaggatcatcgccggggctggggcgggtaagacccggacgattacgcggcgcatagcctatgcctgcgcgagcggggcctgggacccccggcggaccctggcggtcactttctcggttaaggccgctgaagagctgcggggccgcttgaggggcctgggagcccctgacggcatccgcgcggccactttccactcggcggccctccaccagttgaaccgggcttgggcggacatcagcggcgatcactttcctcagctggtaccggacctgcgtccctttatgtccacggcctatcaacgggtgaccggtcggccggacccagatccggtagaattgcgcgatttgttggaggaggcgagctggggcaaagtgagcctggtcgccccggatgactacgccagggtctgcgcggccgtgggacgggtgccgcccgcaggcctggagcccgcgcgcatggccgatgtgatggacgctttcgagactgagaaagccaaccatggggctatggatttcaacgacatcctgctcatgtgctgccacgtgatggaggagttcgacgaggttgccgagcgcatacgtcgcggcgtgggctggctgaccgtggacgaataccaggatgtctcacccctgcagcaccagctcctggacctgtggttggggcaagggcgttctgtatgcgtcgtcggggacccagctcagaccatttactctttcgccggcgcctcctcctattatttgatggactttgaccacgaattcgcaccggtcagcgcggatgtggagttgggtgtggactatcggtccaccccccaggtggttggcatggcgaacaaggtcctggccgcctcgcccgagcgcggcaattacctgcgcctgaccgccgccaaggagtccgggcccaaggtggcgatgacccgctaccgtagcgacgaggacgaggctcagggcgtggtccggcgtatccagcacctggtcagccggggggccaagcctggccagtgcgcggtcctgaccaggatcaacgcccagcaggcggtcatccgcgtggcccttaagcacgcgggcatcaactaccgggtgcgcgccgactccggctggcagcgctcgtccacagccgccgaattggcccagctggacgacgacgagctggtcaaggtccttcgcggagaagggcccggcgaggtgaccatctctaccatccatgcagccaaaggactggagttcgaccacatcttcctggtcggttgttcggaggggctgattccgttcggctcgccccaggcgggccctgagctggaggaggagcggcggctcatgtacgtggcggtcacccgagcagggcggaccctccacctctccttcgctgagcgcaaggaggcccaagggggcggcgggcgctcgccttcgcgtttcctgcgggcgtgaaagcgttccacccagcaggcttttaagaagcgccggccggacccagcacctggggtctgccggcgtctcaaccgtctcgctgtctggtcgctactgagcgccctgcgggtcgtccgcgccgttcgcgccatcggcgccctggccatcgccgggttcgcctggatcatcctgcccttccgggtcgttggagtccttcgtgtcgcctgtctcgccggtgtcgtccaagagcttggccagctcggcgtcccaatcgatgccgcctgacttgccaccagtctcgccgccgccctggccacccgcagtgctggattgtccggcgccagcctgggcgtggccatccgcagcctgcccggggttcgctgccggagacgcggcgctctggccattggcggagtccgtggccgctccagaaacgctggtctggtcgtcatcgcctggcagggagggcagcaggtccgggtggccccacatggcctcgcgggcctggacaccggactgggcggtgacgcgttcccagacctcggcagcctcccgcaggcgcttaggccggaacttcagcccgattaaagtctcgaaggtctgttcggcaggtccagccacggcccgctggcggcgcatcatctcgcgcagttgctccaggtgggggatctgggccttgccggcttgccagaccaggcagtccacccagccgtccaccagcgccagcagggtctccaagccgcgcatggcctcctcttgctccggcgtgtcctgcatccccaccttgcctaggttgatggcctcggccatggactccgggttcaggcttgcggcctggtcgatttggtcctgcatcgcgtccaggtctatgtccacgccgcgcgcgtacttgccgatcagcgcttcgaagcggggcatgagccagggcaccgatgcgtagagccgggcgtgcgcggcctcttggagggccaggaagttcatgacctcatcctcgtccagctccagggcggcggcgtaccccacgatgttctgcgcgatcaggccgcctgctgggttttccaacagcgcgatgccctggtcaaaggagccgtgcacctcgctggacatttcgcccgccgcctggcccagttgcatggcgaaggaggtattgcccaggaggctgatcaaagtcttcgggtctttcagcccttcgggcatgggaatgggcacgggcccggcgaacatgcccgccacctcgccttcgggcaggtcgccgaagcgtgagcccagcacttccagcagggcatcgttcatcgaacgggcgacgggggccgcgaaccgggcccaggagtccatggtcccctccacccaggaggcgcgggtcagtgcctgggcctggccaggggccggattgaagtcgcacaccgcgtccagccagaggttggcttggctcatggcctgggagaccttctgcgcctgcccggcggagaccgtcgaatccgacttcttggcccgcacccgtcccagggcgatcgccttggccagtttgacgttgatcggcccgtcctcggtggagcgcttcatgtccccgggcgtgttgagcccgctgacggagaacgcctccatcatggcgcggacctcctgcgggtcgggcagttgcccgccgttctgggaggagatttgcgagcgtacctgctcaggcagctgggagaactgagtccaggctagttcgccttggatggggccgaagcactcgatcatccactggtgaatctcattctcgtccatgcgctctttccgttctttgataccttcgggctgaagcccgttcgcagggcccgcatcaggcgcccgcgccgtcgcggtcttgggcgcagtggcgttttggccttgttcctccataatatgggagccatggcagattcgcatgtcgtgggcgcttcatacgcgcctagcgcacaacccaacggctccgacccccagtacggcccacggaagcaaggtggcacggaggctgctggtcccggcgcccccggccggccgcacacgctcaagctctggatcaaacgcgtggatcgcaggtcctgggcccttgtggtggtcgctttcctagcggttttcgtgctagccgcccccagcccctacgtgcttgagacccccggccccacccaagacgtgctcggtaactcaggctccgagccagtcatcagcgtctcgggcgcccgcacgtattcgtccacgtccgggggcaagctcctgctgaccacggtcaacgcttcgggcatccccggcgcgcccgtcaccggtttggataccctcatcgcctggttcgacccccacgccaccgtgcttcctgaggaagtggtcttcccctccggccagtccaggcaggagtacgacaaggagagcaagaaagacatggctgtgtcccagggcgcggccagctcccaggccttggctttcctgagttcgcggggggtggatgtctccggggtcaaactttccatgcatgtggaccgcatcggtggcccctctgctgggctcatgtacaccttgggcgcgatcgacaagctcaccgctcaggacgagaccgggggccaggtcatcgccggcaccggcacgatggacaaacacggcagggtgggccgcatcggcggcattcaactcaagatgctgggcgccaagcgcgacggcgccacctggttcctcgccccggccggaaactgcgatgaagtggcgggccacgtcccctccggtctgcgcgacgtgcgtgtgtccaccctgtccgaggcatacagcgcgctcacaaaaatcggtcagggccaagcggactccctgcctcactgcaccgcgtccgccccggctaagcgctagattccggcctctgcccgcgccctgggatggtgaggccgcttgatttgaaggtgtccggggcgggttgctatgctaatagggtggctgagactacaaccaagagagcagaagatttcgacttccacccgggctcaatcgtccaggagtggctctgggatgatgacgtcgatgacgacatccgccagtggatagaggatctgaccggcgaggagctggtagacgaggattacgacgcacaggtggatggtgtgatcatctggtggcgtgatggggatgaggaagacgatttggctgacaccatcgtcgatgcttccaccgccctggaggatgacacccccgtctgggtcttgacccccaaaccgggtagggatggggcgcctggcccaagtaccttgcctaatgcggccaagacggctgggatgaacgcggccatgccgttaacggtcagcaaggactggaacgctaccaggttgcgggctttcggtaagggccggtaagcgacaggtaggcgccaccagcctttcggcgggccatggggagggccgccggcgagctgttcactgcgtctgtttttcttttttattgccgcgccattgcggctcgattccgatgcactcacggggagtggcgcggcggatttggggattgaggaatcactgctcaggcgggacgaggcttgtgggcgatgagggactcgaacccccgacatccaccgtgtaaaggtggcgctctaaccaactgagctaatcgccccgggcattcgcaccccaccttgggatggtgggcaaataccgggaataatcctatcctgacatatggatattttcggtgcccgtcgcaacggacacgtaagctggtgggcagagtattcgtccccggcgagaaagggcaggaggtcgatgtcccgatggcacaagagcctgaatccaatcggagcgacgcgatgatcgcgcgtgcgggcaagcacaagtggggatacgacaccgcgcaggtggacgctttcctggcccgggcgcacgagctctacgagagcgatgtacctaagttgacccagcgggacatcggcaatgtctcctttgatttatgcaaggacggctacatcatttcccaggtggacgccgctttggcccggctgggcaaagccgtctccgaccgctgcgtctcctggcagatcagccagtatgggcagcgcaggtggctggaagaggccacgcagttgcagcagaagctcgcggtccacgccctgcgggccgaaggggagcggttcgcgcctggccgcgacggtgagccggcatacgaccgcaagcaagtggaccggttggtggatcaggtggtggctaagaccgccagccaactgggtctggaatccgccgacccagaggaagagagcaagctggtcgacatcaccgccgaccgtgtatcgaacgtaatcttcacccagcgcaagagcaagcacggttacgacgagcgccaggtggactactacctggtccgggcggtcgagctcctgcaagagctggagtcctacatccgcctgggagtgggggagaacctggctgcgcccaaggcagcgactgcgcatcggcccgtcgagacagaaccggctgcggacgtggaagctggcgaagagaccgccacgttgttccccatcgaggacgctggcgccgccgaaacgatcgtggggatggcccccctgccgcaggaagggccggctcctgccgatcggtccgcgaggcggtccggaagctctgagcccgttgggctcccagtcgtggagggcgcaagcagcgaggacaaggacgaccagttcgatcagctgcacgaagctgaacaagccatattcgagcagccggatgcggccggaccagctgttcctgtgccgcccgccccggctccggtccgttccgctgcgccggtgccagcgccagcccgaagtgaagcgtccaccgccgccgggcaggtccataggacgccagcttccagcgcgcgtccagccccggccgtgcctggtcagcaacctcaaccagcgccatccaacccagcgcggccaagcgcccagtcggtgcccgcccctcaatccggcgtcaggcagaggccagctgccgttactgtggagcctgcagcgccaccagttcctgctgcttctgccgcttctgccgctcctgccgcccaatccagctcttcgctggcggccctggccaaggcagcgcccgccgcgagcgcttccgccaccgctcgaccggctacgacgccggtcgctccagcggtcagccccctccctcccagccgaccggtcagccaggccgcccccttggaagagacgaccagcttcaatccgttgactgactgggacgatgacaccgatttcggtcagcccgattcggatgagaccagccccggtcctgagacggacgctccggcatcggccccaggcccgtcgccggcgccggcgcctgcgcccaaagcccccaagcaagaccggccgcggaccccgagccccgaggagtccctgttcgacgtgcgcctgcccgaggtggacatggacattcccgacatctccttcccctcgattgatggccgggatcaacaggacgacaccaagcggtgagtcaggaccctgcccgcgcccgattgcccatccgggctcttcacagccctccgatagaatgacatccgtgtcgaagtcagatagccagcccagtcagcccggggcccaagctccgggcgctcagtggacctggcgtaggcggctcatggccagcctgcccgtcttcgtcatcctgatgggcatcctggtttccatctcccatctgaccgcggtgccgtggaagtatgagccagtggaccagaacctggtcaccttgacccccgacacagccgtggccttcgacaatcccggccatgcgcccatggagcaggtgggggcttaccgggtttcccagcggtacgcttgggtgaacgccaagcgcgaagccactggcgaggtccagcgaatccacgtgctggtgcgtgagccgatcggggcggcgggcaaaagggctgcggttcttttcatgcacggtgctggctacggcacctgcgataactccttcggcgatgtggcggcgtcgatggcatccgcaggcttcgtgaccgcggtcatcgacaaaccagtctggtccactacggacatcgaccgcgattatccagcctccgccaaggcctacgatcaagtggcgaattacctacgcgcgcagtcgagcgtggaccccgataaggtcggcatctacgccaccagcgaatccacttggatttccacttacctgctggaggacgacccgcgcatagccttccaaatcctgttgagtcccatggtgtactcgccccgccacgccttgggctttttcgtggctcaggacttcgccatcgctggttccaaccccggttaccagtcggtggtcagacgcctcttctctactgacggctcccttttcggcttgggtaacctcgacatcaggacccagtcaaagcgggcctatgccgtgcccacactggtggcgtacggcaccaaggacgtgatgaccgcccaggtggagggggcccagaaaatcatggccgtcgcccacgagcaaggcaattgggatgtgaccgtgcgctcctacgcggtctccaaccacgtgctgcgcttgggtgacgaagccgtggccggcacgccgctggccgaccactacatgcgtgatgtcgtggactggacccagggtcaggcccacgggctcaagcagaccaccgagccggtcgccggatcgaccatccaccagtcaatcgcggtgcccttggacctgtacggcaggcgtaagctgacggtctacatggtcatcgtccacgccagcgcagtcctcttcctgttggccagcgccctgatggccgtggcggcggccggtgttaagctctatcgcctgctcaagcgcgacaagcgcctggtcttgggcttctcccatggctttggcggcaccctggcgggcatcattggctctaccctggcggccctcctgctcttcgccgccggcctaggtcaggttatccaggccttggtccgtttgggctggggcggtgtgcccgaccccgcaggcgtgagcgactggtcctggccggtcatccagctggtcagcgcgctggtggttttagcctggtcctgggtcctggtgcgtctgtacgaggcggcgacgctcaagggcgtgcgccgcatccccgctcaagtcagacgcgaaggattcagcggagctgccatagcccgcaagctcaaggcgaacgattcgggtccggtcctggcctccagtcggttcggcctcgttttcttctggacaacggccctggccatgctctccctgctattggtcttcgccttctgggggctgttcatctactgatggccgctgccggcggcgggcaaggtcgaggacggcctgttcgccagcaggatgaaagggagcccttgtccgacgggcagaccaggatgacggcgtaagagctgataaggggcagatgacagggcagcgggaagggggtgcgtgatagcgacttaccgggatgaaggtgtggtcttgaagaccgtcaagcttggcgaagccgatcgcatcgtcacgattctcacccgttccaacggcaaggtccgggccgtggccaagggtgtgagacggaccaaatcgcgctttggcgcccgcctggagccttttatgcgggcagacctcctgctggcccagggccacagcctggatgtggtctcacaggccgcttcgatcgccgcctacgccgatccgatctgcgccgactatgacttgtactctaacggtggggtgatgctggaatcggcggacaagctggtctccaccgagcatgagcccgcttgcgcccaatacctcctgttgattgcggcgctgaacgccctggcatccggcctgcacggccccaggctgatttccgcctcctacttgatgcgcgccttggccttggctggttggcggccccgcttcgattcttgcatcgtctgctcgcgaccagtcgggcaggcggacctgaacttcttctcggtgcccggcgggggagcggtctgccaagccgatcacacgcccgagtcggtgcgcgtgacgccggccgtcctggcccagctggaggcgctcaccgagggtgattgggccagcctggccaacggccccttggacccgctgactgatcggcttgttgagaaatggggcgaatactacctggagcgccccatccgctccttgcgcctactacattcggccctatgagctttgaaggtgtagattatcagtccctgagcgtgcccgccgcccccttctccaatccggggcgggtgcccgatttcccgaaagacaaagtgccccagcatgtaggcgtcatcatggacggcaacgggcgctgggccaagcagcgtggtatggtgcgcacagaaggccacaaagccgcggagccggtcgtctttgacaccattgccggagccatcgaagctggcgtcagatacctgagtttgtataccttctccaccgagaactggaagcgcagtcctagcgaagtgcgcttccttatgggtttttcgcgagacatcatccaccgtcgagtggcgcagatggatgaatggggggtgcgggtgcgctggtccggccgtcggccccgcctgtggaagtccgtcatcgacgagctggaagccgccatggagcgcaccaaacacaacaccacgatcgatgtggtcttctgcatcaactatggaggtcgggccgagctggccgatgccgccaccgccattgcccaggaggtggctgcgggccgcatcacgggttcgaaggtgacggagaagatgatcgccgagcacctctacaaccccgaccttcccgactgcgacctggtcatccgcacctcgggcgagcagcgcacctccaacttcctgccctggcaggccgcatacgcggaattggcctttgcccacgagcttttccctgactgtgggcgcgatgtgctctggcgggccatcgatgattacatccgtcgtgacaggagatttggcggcgtgcagtctaagtagaccttcggcggtggggtgttaagctagaaatacaacagtttttaacatactgattgatggaaatcaagtgtcattatcagcgtgtccgttcccgcgaggcgtatggtgatagcacaacgcggttcgggataccgtgcatgggggatccgcaaccgcgacgattgcgaaggagcgccgtcatggacgataagcaaagaatcatgcggatcatcgaggataagcggcaggaattcatcgaggccgccgatcacatctgggagacccccgagacccgtttcgcggtcaaggagtcggtccagcagcactataaggtgctggagcaagaaggcttctcgattgagaagggcgtgggccatatggattacgcttacgtggccacctggggatctggcaatccggtgatcggcatcaccggtgagtacgacgcactgggcggcctgagccagaaggcagacgtaggcgagcacatacctgtcgtccccggcggcaacggccagggctgcggtcacaacatcctgggcatggccgcggtcgctggcggcgtcggcatcaagacattcatggaggagaagggcctcaagggcaccattaagatcttcggctgcccggccgaggagtcgggctacggcaaagcgttcatggcccgcgacggtgtgttcgatggtctggacctggccctgtcctggcatcccatggatgtcacctccgcctggggttcctccagcctggccgtcatccaggcctacttcgacttcaccggcatcccggcccatgcggccgccgcgcccgaacagggccgcagcgcattggacgcggccgagctgatgaacaccggcgtccagtacctgcgcgagcacatgattgatgatgcccgcgtgcactacgccttcattgacgccggtggcgagtcggcgaacgtggtccagtcccacgccaggctttactacttcgtgcgcgctcccaagatggagcagaccgaggacctcttcaagcgggtgcggaagatcgctcagggcgccgccctgatgactgagaccgagctcaaggaggagttcgacgcagcctgctacaactacatccccaaccatccgctgaccgaggcgatcgaccgcaacctagacatcgtgggcccgctgcccctgacgcaggatgagctcgattacgagcggcgatacaccgatacggtctcgccctccggcaaacaacaggtgctggcccgcacccaggccgcattccccgacctgcccgccgatgagatcaagtggatggccgagtcgaccatcgccttgaagaagtaccccctgcacttctcttcgaaggcgtccggttccaccgatgtgggcgacgtcagctggcaggctcccaccgcgcagttcaccggcggctttgaaccccagggcacttccgcgcactcctggcagtgggcggctaatggcaagtcttcggtggctcacaaggggctgctggcggcgggcaagaccctggcgttgaccgcctacgacgccctgaccgaccctgaattggtcgagcgagccaaggaggacttcgataagaccttcgaagggcagacctatagcccggtcattccagctgatgtgatgccccactgacatttgcccaaggcgcgggtccggacctaccctgcgaggtggttccgggccacgccctagtcagagttaggggtggggcctcctggatggtggggggggtcccgagagagatgaaagggtccggttgggccctactgagtgtgccgcttcaacggcgcccaggacatcatggagagacgaataccgatggaacgcaaacaatcctcgagaatggcgagtggaaccctcattttctcgctaatggctggttactcgatcgtgtatatggacaagaacatgatctcgaccgccatcatccctatctccgagcagtatcacctggattccgggcaaacgggcatcatcatgtccgctttcttcctgggttactcgcttatgcagattccgagcggatggttggctgataagctcggcgccaagcgtgtgctgatggcatcgatggccatcatcggcgtgttcagctacctgttcggcatcgccaacggtctggccttcttcatcgccgtacgattcttcgccggcatgggccacggcggctacccgccgtcttgctccaaatcgatcgccgagaacttcccgcaagagcggcgcaccttcgtgcaatccctgattttgtccacctcgggcattggtggcatcctggccttcacgttgggtgccaacctgatctccgccaactggcacctggcttacggtgtgctgggcaccctctacctgctggcctgcctgtgcatcctgattttcgtgccgtccaagccgagggagccaaacgtcgacaccgcgcccggcgagaagaaagtcggcttccttgaggtcctgaagaaccgcaacgtcctggtcctcttcctggcgatgctgctgctcaacatcctgctgtacggcaacatctcctggatgcccacctacatcaagacaaccttccacctgtcaatcagccagaccggcctgctgctggcggtcaacgcgatcttctcgaccgccgctaccatctacgccggccagctgctctccaaggtcttcctgggccgcgagaagatggccatcatcggcgccacggtgctcagcgccctcctggtcatcggtttcgtgtactccaagaatctgtggatttcgcttgtgctgctgattatggtctcttgcgtctcggtggtggccttcaccggcatcttcacctggccccacaagatcatggatccgcgcatcatcggatcctcgatcggcgtcgtcaacaccggtggcactcttggcggcttcctagcccccatgattatcggcttcctggtcaaggccgcgggcggatccttcgtctgggccttcaccttcatggccgcggcgtccatcgccgctggcctgatggtcctcttggtcaaggcccccaagactgccgccaagtgatgtacccacggcggcgggcaacgacgcccgccgccgcgttcgctgtcatacccttatattgcatgtcatcatggtcaacaaggaggttcatatggatgataagcagcggatcatgcaaatcattgaggaggaaaaggacgaattcatcgaggcggccgaccacatctgggagacgccggagacccgtttcgcggtcaaggagtcggtccagcagcattataaggtgctggagaaggagggcttctcgattgagaagggggtcgcccacatggactactcctacatcgccagttggggttcgggcaagccggtgattggcatcaccgcggagtatgacgctctgggtggtctgagccagcaggccgatgtgcccgagcccacgccggtagttgaaggcggcaacggtcagggctgcggccacaacatcttgggcgccgcggccctggcggcggcggtgggcgtcaagaccttcatggaggagaagggcctcaaaggcaccatcaagctctttggctgcccggctgaagagtccggctatggtaaggcattcatggcccgcgatggcatcttcgacggactggacgcggctctgacctggcatcccatggacttcacccaggtgtgggccaactccagtttggcggtcatccaggcctactatgacttcgccggcgtgccctcccatgcttcgggagcccctgaactgggccgtagcgccctggatgccgccgagctgatgaacgtgggcgtgcaattcctgcgagagcacataatcgacccggcccgcgtgcactacgccttcatcgatgccggtggcgagtcggcgaacgtggtccagtcccacgccagactctactatttcgtgcgagcccccaagcttgggcaggccaaggagatctgggaccgggtgaccaggatcgcccagggcgcggccatgatgaccgacaccaaggtcacgatggagatggactcggcctgcgctaactacatccccaaccacccgctctcaatcgccatggacaaaaacctggacatcgtcgggcccctccagctaaccgacgaggagatggactacgagcgcaagctcgccgaaaccgtccccgattccggcccgcggaagctggagcgcatccaggcgagcttccctgatatgcccgatgatgaggcccggcagctggcggattcgccgatgttgcttaaaaagctccccctgcacttcagcgatagcgccggcatctccaccgatgtgggagacgtgagctggattgcgccgaccgcccagttcaacggtggtttcgagccgcaaggcacctctccgcacagctggcagtgggtgtccaatggcaagtcgtccgtcgcccacaagggtctgctgatggctggcaagacgattgcgctgaccgcctacgacgccctgaccgaccccaatctgctcgcgaaggccaaggccgacttcgataagaccatgggcggaagccattaccaatcgatcatccccgacgacgtgatgcctcgctgatgccctggtgattcgcgcggatctcgcgtggatcaggaaggcccgccccccgaaccaggggggcgggccttcgtcgtatggctcagccgctatcagcggtcaggcgtctcccagatggtgcccagcttggcgattgacagggagggaatcacggccttgccttcgccggattcagccaccaggcggatttcgcgcggtccgtcagcggggaaggagtaggaggacatgacctccaggccatcgttcacgtagacctcgatggagccccggtccacgatgatgcgcagcttaagcgagccgtgcgccttgtcgagcggtgcggcgcggtagccgcggtcgccataggtgttgcaatggcggtccaggaccacgcgctccagctggtcgtcatagcagaccagggtatgatcgccgttgccggtgcggtggagctccaagccaatccgctcggcctgggagccggccaggttgatctccatctcgatgtcggcggtctcgctgtccgtcaccagggtccggctctcgttcacggccagctcgatgggcccgaactcgcgcttgtcctcgtccagacgggagaattcgcggatgggctgggtgcgcagatggtcgccggccaggctcacctcgcgcggcagtgtgaactgcccgcaccagccgtcgtcctccatggggatgggctgggtgaaggggctcatccagccgaagaccaggcggcggccgtccgggcacccgaaggtctgcggggcgtaatagttatgcccgtcgtcccacaggtggaactcactttcctggtggaagtcgccgcccggctcccaagtgccgatcacgtagccggcgttgttgtggttgcgagcctcaaagcccttgggagagagtcccatggccgagtagcagatcacccacttgtcgtccagggggaacatgtccgggcactccagcatgaacacgtccgggtccgggtgctggtagatcggccggtcgaactcccagttgaccatgtcggcggacttgtacatccagatctcgccccggtgctcgggcgttgagacgccgaagaccatgcgccactcgcctccctgcttccagaccttggggtcgcggaagtgcaggatgcggtcgtcggggcagggcacgaccacgcccagcttggtgaagtgcacgccgtcctcggacacggccatgcactgctcctgcaggttgccctcaccctcattgatcccgttgcgccaacggtgaccggtgtagtagatgaccagcttgccatcgtcggagatgaccgccgaaccggagaagaccccgtcccgctcagcctcgaaggagggggccatcgcgatgggctcacgccgccaggtgaccagatccttgctggagacatgcccccagtggcaggagccccacacgctggcgaaggggttgagctggtagtaggcgtggtagcggccctggaagtagcacaggccgttggggtcgttgatccagccggccttggaggctatgtggctgaccgggtaccagcggtccttgcgggacttgaagagctcctccaccccggcttcggcccgggccagctgctcgctctggtcgtacgtcgtcatattctcaatgttcatccttgagcatcctttcaatgtggttgcttaccttgttgccgttgactttcgtcatcgcttccgcgctcaagctcaggccgcggcctgagcctgggcagccagttgcttgtcggtgaagaaggggtcgccgtccacttcttgatcatcgcgcttcaggatgaatatgccgtaaatcagcgccgcgagcaccaccagggagatcgtgtagaaagtcatacgatcgcccacgcggtcgtggagcatgcccagcggcgtggacaagattacctggcccacctgagaggcgatctggaaaccgaccatgtacagggtggccgacagcttggggttgaagtgcagggtgaagtagcggaaggcgggcagcgagaagagcggcacttcgatcgagtggaagagcttgacgatcgaaaccatgattggatcatggaagaacccgcacaggccaatgcgcaggaacatcacggtcgcgcccaggagcagggagttacgcacgccgatcttgcgcatgatgatggggaccacgcccatcatcgcggactccaggaagacctggaagccgttgagggtgccgtacaccgagttgccgatctccggcgtcgcgaacaggttggcgtaataggtggggaacatctgctggtcgaagaccgtgtagaaggtgttggtgaacatcatgaagacgatcagcagccagagggtgggcatccccaggaccgagaacatgtcctgcagggaggggttggtcttttcgttggggtcggcttccttcttcatctcgaccttttgctcggacggcacccagaaggtgtagaccaggagcatgccgacgccgaacgctgaacccagccagaagttgatcagcgggttgatgttgaagacgaatccggcgatcagggccacaatcgcgtaaccgaaggacccccaggcgcgcgattggccgtattcaaagccgaacttgcgtgagtagcgctcggtcacggcctcgatcagcgagcagccggacatgaaccccgccgacaggacaatcgagcccaggatggcgcccagcatcatgttggtatgcatgagcggagcgtagatgaactgcacaaaggggccgaccagggccgcgatggcggagatgaagatggtcagctgccgcttgacgccaagctcgtcctggatcagaccgtaggcgaacatgatgaccagggtgcccaccgagttgatcgagtagaccgtgccgacctgggtgttggtcatgtgcagcccggtggccagccaccgctggtagaaggaccaccagatgccccaggagcagaagaacaggaagatgcctacggagctctccatataggaagggttgcgccaggctgacaatttcttggacattgtgcctctttcatagagtctcggggccggcatcgctgccggggatttcgatgttgcacgaagcgcagcttgcttcgatgcccccggaaggtcattgtaatgcgtcaatcgtttgacgtcaaacgattgacgcattacgggctcaaagaggcacgtctattgctccttgacgtatacctagcattggcaaccggcttcagtgtgccttagctgtccctagtggctcgccactgagtccttttccaccaagcggcagtggatgagcgccgggcttggaacgtccaacgccggcaggggggctctcgcgccgggtgcttcggcctcgtccatctccagcgttttgccctcgatgattgagaccagtttgtagaccgcccagtagcccatctcgtagtggggcagctcaatcgtcgtcagccgaggagccagcgtctcggcgaacacccgatggttatccacgcccactacgctccagtcggccccgacccgcaaacctcgacgggccgcggcttcatacacgtaccaggcgcgcgcgtcgttgaagcagaaaaagccatccggttcacttgctctgaccaggccctccaccgcgtccagggcctcctggttgaaacccacgtgcacggccaaagccgggtcgaacacccgcccggcctcctccaacgccgccttgtagcccatgaaacgcaagccctgcgccaggattgggtccttgtcccctatgtaagcaatgcgctcgcagcccgcctcgaccaagcggcgggtggcgtcatagccgatctgaaactcgtccggggccacagcggggaagtggcccgtgcgttcgctcgcgttggccactaccactggcagcttcgccagcgaagccggcacatccgcgacccggtcgtacatcttggcgtagagaaagccgtcggccccgtaacgcttgagcgcggcgatctggcgctcctcctgggccacgccgtcggtcgaaaccgtgatgagcatgtaacccagctttgccgccgcgtcctgggcgcccataatcaacccgccagcgaaaggggtcgtggccacttcctgcgagatgaagcccaaaatgcgggtgcgggaggtgcgcagggagcgggccagagcgttggacctgtagcccatcgccttggcttgcccgcgcacccgttcggctgtgtcaggcttgacccggcccttgtcaaggttgttcaggaccagcgagaccgtcgagaccgacacgccagtggcctgggcgacctctttcatcgtggtcatcgacggtcctttctcgcgcatgtgaacgaccccagcttaaccgaggcccttgccgcaagcgtgccgccggcggcgccgcgcttacgctcacggccctgggcgccaccgggttatgctggcactcgcaggtttcgagtttcgctgtctccttcggttccgggtgggtgggtcgacggccggtgaccccagcgggaacgtttgaacgggtggggaaggcttatctctctgattgagcctgaccggagaggagctcgtcgaccagctggggcttgcgttccatctggttgcggaagcctgggcggatatcgagcttaaggctcacgccggtgcggtggccttgtgaggcgagcctgagggcggcgtcgcggaccacgcgcagcacgtcgtccaggtcgccctcgatgttggtgaacatggcgttggtctcgttcttcaaaccggagtcgcggatgacgcccacagcctgggccacatacttggagagctcctcgccagcgcccgacggcgctatcgccaccgcagccaccgtgttgatgtactcgtgggacccgctccggcccttgtccccgtcttccttacgctcattcgtcatagccatccgccttccgtgtgatggatcccagcgtcggtgcaggggtccagtggatacggcgactcggccgcgtcatgctccctccgctggttttagccaacaggttccaagggtcggcctcacggccttctcaactcccagaggagttcccctgcatcgtctttcagcttaggccgcttggacgacagcgggggagcgcgtcaggagggtgaaaacagtcatcagcgcaggataatgtaaggtcattgcgttttcattcgtatgcaagagaaggtgtgactagtggcagcgtcaaaacttgatgaagtcgtttccctggcgaagcggcgcgggttcgtcttccccgccggcgagatttacggcggcacgcgctcggcttgggattacggtcccctaggtgtggccctgaaggacaacatcaagcgtgagtggtggcgcgccatggtcgtcacccgcgacgacgtcgtgggggtggacacctccgtgattctaccgacagcggtctgggtggcctcaggccatgtctccgtcttcaacgacccgctgatcgagtgcctgagctgtcacaagcgccaccgggccgacaccttggaagaggcctacgccgagaagcacgggcacgcgccagagaacgggctggccgacattccctgccccgactgcggggccaagggccagtggaccgagccgcgcgacttcaacatgatgcttcagacccacctgggccccgtggccgacgagaactcgctgcattacctgcgcccggagaccgcccagggcatcttcgtggacttcaagaacgtgatgggcgcctcccgctccaagccgcctttcggcatcgccaacataggcaagtccttccgcaacgaaatcacgccaggcaacttcatcttccgcacgcgcgagttcgagcagatggagatggagttcttcgtcacccccggcacggacgaggactggcaccagtactggatcgacgcccgcacccgctggtacacggacttgggcatcaaccccgagaacctgcgccactacgagcaccccaaggagaaactggcccattactccaagcgcacggtcgacatcgagtacaagttcggcttcaccgggtccacctggggcgagttggaaggcgtggccaaccgcaccgacttcgacctcaaggcgcacgccgagcactcgggcgaggacctgcgctacttcgaccctgcttcgggcgagaagtacatcccctatgtgatcgagcctgccgcgggtctgacccgttctctcatggcctttctggtcgacgcctacgacgtggacgaggccccgaacaccaagggtggcgtggaccggcgcacagtcttgcgcctggacccgcgcctggccccctacaaggccgcggtgctgccgctgtccaagaagcccgacctgcaggccatcgcccacaacctggccggggatttgcgccagaacgaatggatggtggcttacgacgaggccggggccatcggccgccgttaccgccgccaggatgaaatcggcacccccctgtgcatcaccgtggacttcgataccctggacgaccatgcggtcacgatccgcgaccgcgacacgatgaaccaggagcgcgtggcgctggatcgagtgcaggattatgtgcgcgagcgggtcagcgaaaagcgggtgcgttacccggagggacccgcttcgatcaccggcgccaccgcggctgatggctcggtggatgtgagccaggagtccggtgaggacgagtcccagccggtgcaagtggccgaggccggtggcgagtactgagccaagggcgctgcaagcgatgagtcaagagcggatcaacctcgccccagtgcgcctggggccgattagcgtccccacgccggtggtgctctcgccgatggccggcgtgaccaactggcccttccgagtcctgtgcgaagagtatggccctgacgggctctatgtggcggagatggtgaccgcccgggccctggtggccggcaatcccaaggcttttcgcctgtgccggttcgcgcccagcgagcgggtgcgctccctgcagctctacggggtggacccggcgatcgccgagcaggccgcgcgcatagtcgtggatggaggcatggccgaccacatcgatctgaacttcggctgcccggtgcccaaggtcacccgacggggcggaggctcagcgctaccctggaaactcgacctgttcgcggagctgattcgtcgaatcgtggctgtctgcgagcctgccggcatcccagtgaccgcgaagatccgcgtgggcatcgacgccgagcacgccaccttcctggaggccggccgcatcgcccaggaggagggctgcgccgccgtgaccctgcacgcgcgcactaccgccgaatactacggcgggcactccgactgggatcgcattggccagctggtccaggcgttggacattctggtcttcggcaacggcgacatctggtgcgccgaggacgccgaggacatggtgagccagaccggatgcgctggcgtggccgtcgggcgcggatgccagggcaggccctggctcttccgggacatcgccaacgctttcgccggttccgacgagcggttcgagcccacccttggacaggtggggcaggtcatggcacgccatgcccgcctgctggtcgacttctacgatggcgacgagcgcatggccgtccacgatatgcgcaagcacgtggcctggtacgtcaagggtttcccggtggggggagccacgcgtcgagcattcatggcctgcgagaccttggctgacttggacgcgcgaatagccgagctgccccaggacgagccttatccgaagaccgtggccgccaagccgcgcggccgtgtgcgctatgctaaaaaggtccgcctgccctccggctggctggactcgcggaccaccaccagcgaggagcgccgggtcctcttcggcgacgatccgatggatgcctcgtattaagtgcgccacggccgaccgcggtggtcggaggggctctgctaggtttgtgcagggattgaggggaagtcgcgtgaaagggctggaaattctcagctcagacaaccgagaggtagtctagaatagggctgatgcggggtgagcgtgttggcgtatctggtttgcgctagagttggccctaacgcggagtgacaggagcatatggtgagcgagattgcccagactgacaatttcaatgacaagaccaatatcaaggtcgtcggtgtcggtggcgcaggcggcaatgcggtcaatcgtatgattgccgagggcttgcaaaacgtcgaattcgtcgccatcaataccgatgccaaggacctcttgcgctccgaagcgaacgtcaaaatctccttgtccgactccaattcacgaggcctgggcgctggggctgatcctgagaaaggcgccaaggcggccaaggaccaccagtccgacatcgaagaggtactcaaaggctccgacatggtctttgtcacggcaggcgaaggtggcggcaccggcacaggcgccagcccaatcgtggcccgcgcgtcccgccagcagggtgcgctcaccatcgccgtcgtcactcgccccttcaccttcgaaggcccccgccgcgctgcttccgcggagtccggcatcgagaacctgcgcaaggaggtcgatgcgctgatcgtcatcccgaacgaccgcctgcttgacctgtccgatcgtacggtttcggtcatggatgcctttaagaccgccgataccgcgctcctggccggcgtgcagggcatcaccgacctgattacgatgaactcttacatccacgtggacttctccgacgtgaccgccatcctcaaggacgctggcaccgcccttttcggcatcggtgccgcccggggagaggaccgcgccacccaggccgccgagatcgccatctcctcgcctctgctggaggagtcgatcgagggcgcccacggggctctggtgaacgtttccggccccactgacctcaccctgcaagaggcttcggccgccgtcgagctggtgcgcagcgcgatacatcccgaggcccagatcatcttcggtctggccttggatgacgcctacggtgacgaagcccgcgtgacggtcatcgcggccggtttcgaccccagcactcagcagtcctcccgcttcaagccggagtccgcaggtgggaaggaaaccgccggcgtcacggaccagggcgattcccagcccctgggccaggcgggccagtcttccgagaccgagaacgagaaccaggcttggcagcccgccgatgataagtcgaatcaggacaaccatgaacccgaggatggtgacgacgaccagtccaagcctacggacatgggctacctggacatcccggatttcctgcgctgagggagcgtgaatccaagggcacgaactgtaaaaggagcggaaactcatggcaggattgatgaagagcgccatgtcgtacttcggtatggcggacgtcgtggatgacgacgaggaggagaacggccaggtgggcgacggcatggactccagcttcgataccgaccactccgtcactccgattaccaacacagccgtctcctccgctggctcggcagccgtttcagccgcgcccgccagttccagtcccttccagagtcggctcaaccgcatcaccaccatccacccgaggaactacgaggacgcgcagatggtcgggcgtgccatccgggacggcgtgccggtcgtgctcaatctgactggggtcagcgagtccgtggcctaccggattgtggacttttccgccggcgtggttttcggagtccgtggttccattgagcgtgtcaccccccgcgtcttcctcctgagcccggctcaggtcaacatcaaggtggaggaagctgaatccacctccaactcccacgacatcttcgcaggctgaggcggaccgcccggcctggcttcgtacctaaggagacccgccgcctatgctgataggccttttggcgtacctgatcaactggctgattgatgcttacatcttcgtcctcttcgtgcgcatgctcattgattgggcctttgtgctggcccctcggtggtatccacatggcctggtcggctccctggtgtccatcgtctaccagctcaccgagccgcctctgcgttggctccgccggtacatcccgcccctgcccttgggacgcatccaattggacgtgagtttcgtgctcttgtggttcctgttgattgtcctgcaagtgctggtgaacgctttgatctgatccagcgtgtgctcacaaggctgatatagtcgtcaaatataaagggggacgcggccggagtgaggtttccggctgtttgtatacatctgcacgtgctagcatgtgtacaagaacagcaatgtcggtagattgttgcctgaagcgaggtggagaaacacatggctcttttgacgccaaaagacatacgggagcataccttccaaacagtgcggttcaaggaagggtatgacgtcgatgaagtggatgacttcctcgatcaggtgaccgagaccgtcgaagcgcttggcaagcaagccgtgcaaggcggcggggcctccacccagtccttcgggcccgacgtggccaacttgaactccaagatttccgagctgaccgcgcagattcaatctctccaggccgagaaccgggatctcaaggcgcgcgcggcctctgcttcgcagcagaccggcgtctcggcggcccagcagccagacccagcggcccagcgtcgtgcggctgaggccgaggaacgcgcccgcaccctgggcgcccagaacgagcaactgcgcaaccaggtcaaccaactcaaccagcagattgaccagttgaccgctcaggcggcacgcgccggcgccaaccagccttccaacgaccagctctccaccctccagagggaacgcgacgaagcccgccatcaggccgaagagctcaaccaggaactggcttccaccaagcgcgacttggctgccgcgcagcagaacgtgaccggttcccgtcagcagatcgcccgcttccagcagtccatccaagaggagagcagcaagaccgcgcagctcactcgccagcttgaggatgcccgtaagcgtgagtccgaccttcgcgcccaggtttccaaggtcgagcccgccccggagaccggcagcctccagcagatcgccggcgcaggcgccaacgcctcttcggaggcggagcgagccaccgccatgctgacccttgccatgcagctgcacgaccagtacgtcgacaaaggcaaggcgaagggcgccgaaatcgtctccgcctcccagtccaaggtggacgaagccatgtccaaggctgacgcatatgcacgcaagacccggtccgatgcggacgattacggccgtcgcatccactccgaggccgattcctactcccagcgcgtcaagggcgaggcggacagctattcaggcaagattcgcgaggacgccgacgcttactcccgcagcaagcgcaacgaggccgacgagtacgagacccaggtgcagcagcgcgcccaggcttacgacaagagcacccgcgaatccgcggagcgctatgcggccagcgtgcaggacaagctcatggcccaatccaaggtcatcgagggcaacatccagagcctcaagcagttcgaggcggagtaccgcagccgcctgaccgagttcctcggccagctggtttcgcaggtctcggataccaacaactaccagcttgtcgaaggcaccggcagcgctggcaaccagcgtctctgagagccctgcacccttagtgaccacagcgcttaccaagactcccagacggctacgcactcgcgtggccgtcttcgcatgcctggccttagtggcgatggccctcgaccaggcctcaaaagccctggccctcctgaagctgggagggggcaggcgggttgaaatcattcctggcctgctctccttacggcttctgcgaaaccctggcgcctcactggggctgggctcccgggccacatgggtcatatccctgctcgccatttgcgcctgcctggcctttatcatcctcctcctacgcactggatcgatggcctggaccttggccttggccttcgccttcgccggggcggccggcaacctgatcgatcgggtggcctacgctcgtggcttcctggatggggcggtcgtcgacttcctggactacggatggtcggtcggcaacatagccgacatctacctggccctggcggcagtggccgtcattgtgatgatcatcttcggtccgcgattctcagccgcagcccccgcctcggacagggaggcccaagagcggggggcgcagcagtgacctccaaactcctgcccgcgcctgacgctctggttggcttgcgcttggatacggccctggccaagatgatgggcgtgtccagggccaaggccggggagctgatccttgagggccgtgtcagcttgttggggcgtaaggcccacaaggccgccaccctgcaggcgggtgatctggtggagctggacgagccggagcccgagcaccagatcgaaccggtgtgcgaggacatggccatcgcctacgaggacgaggacttgatcgtggtcgacaaaccggtcggggtggccgcgcacagctccgccggttggaacggacccaccgtgctcggcaccttgctggatcgcggcgtgaggatcacctccctgggcgcttcaggccgccagggcatcgtctcccgcctggacgcgggaaccagcggcctgatgctggtgtgcaagtcggacttggcctacagggccatgcgccggcagttcgcccagcacgaggtggtgaagatctaccatgccttggcccagggcaacctggcccaagacaaggccacgatcgaagcgccgatcggcagggccaaggtgcgcgacttccgcttcaccgtcaccccagccggcaaagaggcggtgacccactgggacgtgctggagcgcttcggcgaagccaccctggccaaggtcaatctggagaccggacgcacccaccagattcgcgtccacttttcgtcaatcggccacccgctggtcggcgacagcatgtatggagcgaatcccgaacttgctgagcgcctgggcttggagcgacagtggttgcacgccatacggctggaattccgccacccccgcaccggcctgtggaccacggtcgattcgacctaccccgccgacctggcggccagcctggagaccctgcgccgggagaccgcgagatgacccgcgcacggacccctatgccttcagctcaccgctaggcgagccggacaaggggaggaaaccgtggcaaaccgcgcctgggcggaacttccctggccacccgcctcgctgtgaatgggcgggcttgtgtcggggcctttagtagattaggagtatggcttccacagttgctccggacagtttcatccacctgcacaaccacacgcactactccactttggacggtgcctcgaaggtgcctgagctggtgcaacaggtcaaggccatggggcagaaggccatagcgattaccgaccacggcaacatgcacggcgcttacgaactctggcggaacgcggtggacaacgacatcaaaccgattatcggcatcgaggcctacgtgacccccgagaccgcgaggcaggacaagacccgcgtgcattggggcgatgagacccagcgctcggacgacgtgtccggtggcggctacatcacccacatgaccatgtgggccgaatccgacaccggtttggtcaacctgatcaaggcgtcatcggtagccaatctggaaggcctggtcggcaagtggccccgcatggacaaggaagtgctctccacctactccaagggcgtcatcgccacgaccggctgcccctccggtatcgtgcagacccgcctgcgtttgggccagtacgacgaggctcttcgggcggcgggggagttccaggatatcttcggcaaggacaactactacgtggagctgatggaccacggcctggagatcgagaagcgggtgaccaaggacctgctgaggatcgcgaaatccatcggcgcccctgtggtggccaccaatgacgcccactacgtcaaggaggaggacgcgggcgcgcaggacgcgctcctttgcatcaactccggcgcccacctggacgagccagggcgcttcaagttcgacggatcgggctactacatacgctcagcccgggagatgcgcgacctcttcaaggaattcccccaggcttgcgacaatacgttggaaatcgccgaacgctgcaatgtgatgttcgacgaccacgaggacggggccttcatgccccggttcgactgccctgagggctgggacgagacctcgctcttcctcaagcaggtggatgagggcctgaagaagcgctatccgggcggggtgcccgccgaagtctccaagcaggccgactacgagtgcggcgtcatctgccaaatgcagttctgcggctacttcctggtggtctccgattacatcaattgggccaaggagcacgggatcatggtgggcccggggcgcggttcggcggcaggctcgatggtggcctacgcgatgggcatcaccgagttggaccccctgcggcacggtctgattttcgagcgcttcctgaacccggagcgcgtctccctgcctgatatcgatgtggatttcgaccccgaaggccgcatgaaagtgctggagtacgtggccgacaagtacggttccgacaaggttgcccagtgcgtgacttacggcacgatcaagaccaagaacgccttgaaggactcggcgcgcatcatgggctacgagtactcgatgggcgacaaggtgaccaaggccctgccgccttcggccaacggcaaggacatgagtctcaaggacatcttcgaccctggctccaaacgttacccggaggcgcgcgagttccgcgagctctacgactcggacccggacgtgcaccggatcaccgacgaagccaagggcttggaaggcatcatccgccagaccggcgtgcacgcctgcgccacgatcatgggcgccgaaccgatcaccaacacttcgccgctcatggaacgcaacgacggcaccgtgaccaccaccttcgagtaccacacctgcgagaccctgggcctggtcaagatggacttcctggggctgtccaacttgagcgtgatccgcgactgcctgaacaacatcgcgcgcaacgggaaggagcccatctcctaccaggagatcccgttggatgacaaggagacttacgagctgctctccagaggcgacaccctgggcgtcttccagctcgatggcgacggcatgcgctccctcctgcggctcctgaagcccgataacttcaacgacatctccgccctgatcgccctctaccgaccgggccctatggatatggattcgcatatcaactacgccaagcgcaagaacggccagcagaagatcgagcccatccacccggaggtggccgagccgctgaaggaggtcctggacgagacctacggcctgatcgtctaccaggagcaggtgcagtccgcggcccgcatcctggccggctactccttgggtcgggccgacgtgctgcgccgggccatgggcaagaagaaacccgaggtcttggccaaggagcaggtgcccttcttcgagggcatgaaggagcacggctactccgaggaggccgcccaagcggtttgggacatcctggttcccttctccggctacgcgttcaacaaggcccactccgccgcctacgccttgatcgcgtattggacagcctatctgaagacccactacccggtggagttcatggcagcccttctccagggcgagcgcagcaacaaggacaagaccgccctctacctgggcgaggcccgacgcatgggcatcaaggtcctgccgccggacatcaacgagtcggtttccgagtactccgccgtcggcgacgtggtgcgcttcggcttgggcgccatccgtaacgtgggcgacaaggccgtcaaggagatcatcagcgagcgtgagggtaagcggggcaagttcgtcaatttcctggacttcgtcaagcgggtctcgatggaggcgctcaacaagcgcacggtcgaatccctgatcaaggccggcgctttcgacgagaccgacggcaaccgccgggccctcttccagattcatgaggtggccatcgatcaggtggtgccgctcaagcgcaagcaggccgaagggcagtttgacctgttcgctgacgaggaggacacgtccgaggccgacatcctgggcgacgcggatgtctccgtacctgacatcgaggagtgggacaagaagaccaagctcaacttcgagcgtgagatgctgggcctgtatgtgtccgaccatcccctgtccggcatggcttcggtgctggccgggttgcgggacatgtcgatcgcccagctggtggaccgggcctcgaccctgggcgaaaaccagagcgtggccatagcagggttgatcacttcggtggatcggcgcgtatccaagcggggcaacccctgggcgcgcgtcacgattgaggatttggagagctcgatcgtctgcaacttcttcggcaaatcctacgaaaaggccagtgaggacttggcgctggatacggtgatacgcgtgcgcggccaggttgagatccgcgatgatggggtgagcatgcgggccttggacgtggaggtgccgaccctggaggcggcggacgagcggccgctcgtgatcaccctgccccagggggcgatcgaccgtgggcggatgcagcggctggcgcgcatcatcaaggaccatcctggctactgccaggtgcaactggccgtgtgtgacgccaagggcaacgtcaaactcttcaccttcggcgacgacttccgcagcaagcacgacacgtcgatgctggcggagatcaagaccgtgttcggcccttcctgcctgccggccgcatgattgggccggacgggccttggaggactgtcggccggcgatttcagccggcgcgtgtaggttagtggaagcaagtcaagcagtcgaggaggcgccatgagcgagcgggattcggaccggccggagttttcggcaggcggcgaggacgatcacctgagcgacgaggagatcgagcgcgccctggcgggattcgagcaggagtttcaagaggacgccgccggagggtcccaggcctcagacgggccgcttgacggccaggcagggccccaggaggccgaccccctgacctcgggtggcttcgatgaggagttggaagggctgattgggaacaaggccaaggccgcccttatcgtcacccgcctggcctcggctgagctcttggccgccttctgccagatttccgacatctccgccgtctgcttggaagacagcgagggcgcagtggcggtcttgcgcaatctggatggggacgggcccgaggcggcggtcaaggacctgacctgtgtgatctccggcttgagcgccatgctggtggtcaacagggccgacaagctggaggccaaactgtgggtggatgggcgttcgggtgaagccttcccgcctccggtcctcttcgcctcggcggccgggttcgtggaggacctgctgattggcgccgccgacgtggacatgctcacggcccagggaatcaagtccttcgactccggcgacatggaccaggcccatgccatgggggtcatcgcctcccatacccgcttccgccgtggaggcggcccagcctccggcagggtagaataggacccggcgcgctggccgcgaggaagcggctggcgttgcggcagaggacgttgcgcttcaccggcaggccacacgtcgttaacatgagccgggggtcatggaaatattggcatgggagcatatggccatggaaaaacaagaagagttcgccctgcgtacggtcgaggaacgcgatgttcgcttcatccgcctgtggttcactgacgtgttggggaccctgaaatcggtggccatcgcgccggccgaattggagaaggccttcgatgagggactggggttcgacggctccgcgattgagggcatgacacgggtctccgaggatgacatgatcgtcaagcctgacccctccactttccagatcatgcccgcccggggcaatggacaaggcacggccaggattttctgcgacatcctgacccccgacggcgagccaagccggggcgatccccgtcacgtgctcaagcgctccctggcccgcgccaaagagaaggggttcaccttctacacccatcccgaaatcgagttctacctgttcaaggcccaggaggactggtcgcagccacccgtcccaatcgacgagggcggttacttcgaccacgtgccccggagcccggctatggattttcgccgctcctgcgtgagcatgttggagcagatgggtatctcggtcgagtactcccaccatgaggccgggccggggcagaacgagatcgatctgcgctacgccgacgccctggccactgcggacaacatcatgaccttccgcaccgtggtcaaggagatctccctggagtgggggatgcatgcctctttcatccctaagcctttcaccgacaagcccgggtcggggatgcatacccacttgagcctgttcgagggcgacatgaacgctttctacgaggtgggacaggagttcaacatgtccgcccaggcccggcagttcgccgctggcatcctggcgcacgcggctgagatttgcgcggtgaccgaccagtacgtcaactcctacaagcggctgtggggcggtgccgaggcgccctcctacatctgctgggggcacaacaaccgttccgccctgctgcgcattccgcagtacaagcccggcaagggcaactccgcccgcatggaattccgcgccctggacccggtggccaacccttacctggccttctcagtgctgttggccgccgggttggacggcatcgagcgcaagatgaccctgggcgatcccacctccgacgacgtgtgggagctgaccgacgccgaacggcaggccatgggcatccagcccctgcccgactcactggacacggcgctgaaaataatggagaagtccgagttcgtggcctctgtcttgggcgagcacgctttcgagtacttcctgcgcaacaagcgtcgcgagtggaacgagtacaaccggcaggtcacgccctacgagttggagttctacctgccccgcctgtagaaccgcccggcctcgcgcaggaccggctttggcttgggcgaggccgacggggttgactgcttaggcgggtcgaaccagttctggtagatgactgagaagttcctgttgccgtaggctgagcatgcatcgccctcgcccacgccggccttgagggcggcttggttgggttggtaaggcgtgtagatgtagagcagggcggtcgcatcattctcgatgtagacgtctgaagcgccgcaggaggccttgggggagtagcgcaccgagttgatccgcccaggcttgaactggtactcgtccatgtgagcctggtagtagcggtagcggtgggcggctccatacacttggttgaagaagcccgcgtaagccgggtcgcagtccgcgtcgtcggggcaggacaagcccatggccgccttgtactgcaagggcgtgggggcagtggccgagaccaggtgctgctccttttgcagcatggtcagcaggaccttctggctgatcctgcaggagcgggcggccccatcgatgatggtggccgctgactgggctttgccgccctggtactcgtcgcacaaatcatcggccggcttggacggaacgtccaccttgtaggacttgaggcagggttgtgagcttctggtggtctgggcggtgcaggtggcgcctttcttgtccaggaaggcctgcacgtcgtccgcgttcatactggttgtatcgaagaagcgctggtcggagataatcagcccaggattgaacccatagaggtcgttggattcctcctgtccatggcggaccacggagacccgagcctggtagctgaggaaagccagcccggtgatgaccagggccaggaccaggagggccgccagcgtcgcagcggcgcccgtctccaccctgcgggcgagggactggcgccgccagcgggcgtagaggcgctcgaaacctcccttgcccctgcctttggacttggaattcttcgacgatgcgcgagtgctcatctcaagcctccaatgctttgcgaatgcgctggatgctgaccgggcgaggggcgccaagctcctgggcccacagggatacgtagaagtcctccaacatccaacgggcgcggtcggtctgctccgccatctcctcgcgtcgagggccggcgggtagcccatccgcccgggcgcgtgccttatcgactagctgcttggcctcatccgcctgccaggcccagcgtacatcgcggtccttatcgacccgggccttggtcaggcgaatcaggtcggcgtgcaagtaccgctcgaaggagggcagcgcttgcgggggtgcggcgccgatgaagccggtgtgcaccagggaggcggcatggtcgcggatccattgcaggaccgagagcatgggcaggtcggcgggcccggagaccgctttgtccacctcggcgtagcgctggaggatgacgatgatgtcttgggccaggcgatagaccgtgtcctcgaaaacgccggagatcttgtagaccgcctcggtgagcgcttggtcgtcgggcaagtccgccacacgtggcagaaggcgctttaccgcagccagttgcaggtcatcgaccagggccttggttgacgggtagggggcggccgccagcatcagggcctcacggctcagccaacgcgaggaaatccgctcgtcaggaagcttcagggtcttcagggccccttgccagagcatgtcggaacgggggatggtggtggcaccggaacgttggagcaggtcggcgcgcttgaccacctgcccctgccgggcagccttgcgggcctgagtggagacccgggcctgggcagaccgccgcgcgggttcggcgaagcggcgctggaggtcgcccagggacttagagcgaccgaggaccttgccctgaggggcgccggagcgctgccctgggcgccgaccgtggcggtcatggttgccatgcccgccacggccggtttgcgtcggctcctcgaccgcgaaggtcatgcgtaggtatgggggcaggcggtccagctgctcgggcgagaagacctgggggtggacctgggcgccgaccacatcgatcgcggcctgggtgaacacctgatcgaagggtggccagggagcggcgatgggcttggcgtcggattcagtgggcggctcctgggccgggtccaaaggcgcgctgcccggcaggcgtgggtagcgctcgtcaatccaggcgcggatggcccgggctgtgtccggggcgggcacgaactggcggcgcagggccttgggcagggatttgatggtggccacaatcagctcatccaggaggccaggcacgttccacgtgaactgttcaggggtcagctggcccagggcggccagcggcacgtgcagggtgaccccgtcctcaggggactgggggtcgtagacatacgacagacgcaggtcaatcggggagccatcggtgcccaccgtgtgccagtggtccgggtagtcgcccgggcgggccgaggattcgccctgacgcagacgctcgacctgggtcgggtcgaatgtcagcatatccgggtccttggctcgagcgcccttccaccacttggccagggcggccagggaagtggcttcctgcgggaggcgctcattataaaagtcgtaaaggtcctcatcggtggcgctttgggcgaccaggcgggtcttggaggcttgttcgccctcctcttgcaggacgcgacggttgccctcgatgaagtcgtcgtaggagaagcgctcgcggatgtcgccttccacgaggccttggcggatcaagaagtcccgagcctccgaagggttgatcgaaccccacaggaccggccggcccgatacgatcggcaggccgtagagcaggaccgtcgaggaggccacagcggcccccttggtggcggaccagtggggttcggcgtaggtgacgcgagtcaagtcgccggccaaggactcggcccaggctgggtccacggcggcgcagtagcgtgcccataggcgggaggtctccaccaggcctgctgccatgatccaaggtggaggggtcttcgccagggcggatgaggggaaaatcgcgaaacgggtgccgcgcgcccctcggtactcgttgcgcgagcgcttctgggcccgcttgatggccttggcccgggccgcgcctttcaagccggcgaattgggaggccttgggctcggtcaccacctgcatccccaggcttgaaagaaggccggacaacatgcagcggtggaggccttctccgtcccaggagcaggccagcgatccccgcccctgctgggccaagggcagggcaagggcctcgctcttagggccggaagccggtcggggctggcccaccttcatgcgcatgtcctggcaggtctggtccagctgccggtacaggtcgtgccactggcgcaagcgggggaagctcaggaactcgttcttggaaaggcggcgcagggtagaggaggaggccttgccgtctgggaagcagtgctcccagaggttcagcacggtcacgaagtccgaggaagggtcctggaagcgggcgtggaggcggtcggcttcgtcgcgtttgtcctcgggtcgctcacgcgggtcctgcaggctcaggaaggcgacgaccacgatgaccgcggccagcgtgttgggtgtggcctcacggtcggcttgaaggatcatgcggcccaggcggatgtcgattgggatgcgggagagcctgcggcccagccggttcagcctgatgcgcccatggtcgcggtcgatggcgccgagttcggtcagctcgttgaagccgtcggagaccgccttgacgtccggtgggtcgatgaagccgaaaccggtcacatcctgggccgtgtgcgctacgccgactgaaagcatgtgcaggacgacggcgcccagggaggtgcgcaggatttcagggtcggtgaagcgtgggcgggattcgtagtcttcgcgcgagtagaggcggatggcgatgccgtcggccactcgtccgcagcggcccgccctctggtcggctgaagcctgggagatcggctcgatcggcaagcgctggaccttggctgacttggaatagcgcgagatgcgggccaggcctgggtccaccacgtagcggatgcctggcacggtcaacgaggtctcggccacattggtggcgatgatgatgcgctggtgggtgtggggctggaaggcgcggtgctgctccttggcggacagtcgggcgtacaagggcaggatctctatcgcgtcgggtcggcgctggtctgaggcgcgcgggccccagtggcggcgcagggcggcctcgtactcgtggatgtcgtgctcgccggcggcgaagaccaggatatccctggggccggtggcgtggctggaaaggatgacgagctcggcgcaagcccgggccaccgcccccggaaggtcggcttctgccgtctctagggggtcgccggagtccggggccacccgtggggccgcgaagccgggtacttggctcatgagggccggcggggcgcccaggggctcgtagacggtctggacggggtacgtgcgcccggagacctcgatgaccggcactttggtgtgcagggccttggcgaagtgctcctggaacttgaccgaatcgatggtggccgaggtgatgaccagctttaaatcgcggcgttgggggagcaacgcggtcaggtaacccagcaggaagtcgatgttcaggctgcgctcgtgcgcctcgtcgatgacgatggtgtcgtatgcgctcagcttggggtcgcgctgaatctgggccagcaggatgccgtcggtcaccactcgcaggcgggtggagcgcgaggattcgtcctcgaagcgcacttggtagcccacctcgtcgccgagtttgacgcccagctcgtcggcgatgcgctcggccacggtgcgcgccgcgatgcgtcggggctgggtgtgcacgatttggtgaccgtgggagcctcggcccatttggaggaggattttgggaatctgcgtggtctttcccgaaccggtctgaccggagacgatgaccacctgactggatttgatggcctgctcaatacgatcgcgcgaggctgagaccggtagttcgctggggtaggtgaacttcatggacgggcgacctcaatcacccggtatcccttggcggaggcgtatttggcgacgccccagtccgtcggcatctgggaggacagccaggtgatcaacgagtcagagcccaggttgcgctgcaccacgaggtaggcggcgcctccggggttgagccggggtaggtagtccatcagaagctggtggaggacggccttgcccacgcggatgggcgggttggaccaaatcaagtcgaatccctggccgcccggcaggtcgtcgggcagggtggcgcggatgttcgtcaggccgtttgtctgagcgttcgcgcgggtcaggtccagggcgcgctcgttgacatcgaccgcccagaccctggccttgccgcgcaggagggccagttcaagggctatggggccccagccgcagcccaggtccaggaagtccccgctttcgggcggctcgggcgcgcgcttgagcaggaccgatgtgccaaggtccaggcgggaggaggagaagaccccgttcgagacctggactttgacgggacgcccggccagcgtgacgttgatggtcctgcgaacgtcgggcgagccaggttgggccgagaagtattgttcgtcccctgtgtgtcctgcctgccgtccctggctcacgttcgccgctcctcttccttggtccatgctcgccgagccgccccccgcttgggctgctggatgcattccgattgtatccgcccatatggtccgtcaagcggggggtgaaatcctgggtgagatccggggggcgggagcgaagcggctgggaagggctcgctgagggtggattagtgctgggcaggttatagagtgggaggatattccatcagaagaggtggcagtgacccaagagtccgaacaatccaaggccgcgcaggcttttcagactgacggagagtggcaggacacgcgcgcggacgcgcccttgcacggccgttcccaagtcctgcttgaccaggggcagtcaggcccggaggagggcgaggccgatgaggcctggcaggagcgtgagcggcgcaatcagttcaaacacgttgagggccttggcgagcttgaggatgtcagcgaggtcgaataccgcaaggtccgcctggagcgggtggttctggtcggggtctactcctcggcaagcagcagcttggagaccgccgaggagtccctgagggagctggccgcactggcccagacggcgggcgccgaagttttggacgggctcctccagcagcgcgacaaacccgaccccgccacgtacataggttcgggcaaagcccggcaattggcggatgtggtggccagccaggaggccgacacgatcatcgtggacgacgacctgcagccttcccagcggcgggctttggaggacgccaccaaggtcaaggtcgtggaccgcaccgccctcatcttggatatcttcgctcagcacgcctccagcagggagggcaaggcgcaagtggagctggcgcagctggagtacatgctgcccaggctgcgcggctggggcggctccctgtccaggcaggccggcggccaggcggcgggccagtcaggcggcatcggctcccgtgggccaggcgagaccaaaatcgagaccgaccgccgggtcatccgccaccgcatctcccggcttaaacgacaaatcaagcagatggcgccggccagggaggtcaagcggggctctcggcggcgttatgagctgccgaccgtggccgtggtgggctacaccaacgccggcaaatcctccttgattaatcgtatgaccggctccaaggagttggtggaaaacgctttgttcgccaccttggacactgcggtgcgccgggccagggcccgggacggcaggctctacgccctggtggatacggtcggtttcgtccgtcgcctgcccactcagctggtcgaggctttcaaatccaccctggaggaagtgggccaggccgatgtgatcgtgcacgtggtggatggctcccatccagaccccttctcccaaatcgaggcggtcgacaaggtgctggccaccattccgggcgctgagggcatcgcccgcgtcctggtcttcaataaggccgacctgatggatccgtccacccggcaacggatcggccgcttggagcctgacgccttcctggtctccgcaggcaccggcgagggggttgaggctttgagcgaacgggtggaggccatgctgcccaagccccatgtgcgcgtggaggcacggttgccctatgcgtcggggtcgctcctgtcccgcgtgcgccagtatgggaaagtgctatccgtgtcctaccgtggcgacggggtggacctcgtggctgatgtggacgaccgcctggccgcgcagatcatgagccaagccatcgagccggatggataggcctggaagcctacgaggcgtaaggggttggcactcgtccgagctttcgcctacgggctcttggcgtttgaaacagcgtgcgccaggcaaggacggccgtggcctggaaaaggtcagcgattatggatacagtgaatcagtgaacagtgatcacccttgcggggggtctcgtatagagaggtctgacaaatatggcagaatcacccatcaaacccactaagctcgctattgtcggcgcaggggcggtcggttcgaccctggcgttcgcggcggcccagcggggtgtggcgcgtgagatagtcctggaggacattaacctgcagcgggtgcaggctgaggtgttggacatgcagcacggctccagtttctaccccacagtctccattgccggctccgacgatcctgagatctgccgggacgccgacatggtcgtcatcacggcgggggcacgccagaagccagggcagaccaggcttgacttggccggagcgacgattgacatcatgcgctcgatcattccctccctggtcaaggtggccccgaacgccctgttcatgctgatcaccaacccggtcgacatcgtcacccgggcctcgattgagctctccggcctgcccaaccaccagatgttcggttccggcacgaacctggattcggcccgcctgcgctacctgatcgcccagcagaccggggtcaacgtcaagaacgtccacgcttacatcgccggcgagcacggcgactccgaggtgcccctgtggtcctccgccacaatcggtggagtgcccatgtgcgagtggaaggaactgcccgggcatgaaccgctggacgccgccaagcgcgaggagattcaccaggaggtgaagaacgccgcctaccggatcatcgaaggcaagggcgccacgaacttcgccatcgccatgtcgggcgtggatatcatcgagtcaatcatgaacgacacccaccgaatcctgccggtctcctcgatgctggacgacttccacggcatatccggcgtgtgcatgtcggtgccttcggtcctgaccaggcaggggatcaacacccacatcaataccccgctgtccgacggggagctggccgccctcaagcgctccgccgagacccttaaggagaccgcttctcagtttggcttctaagcctgcgtcagtctgatacagtgggccacccctccagtggggtagacgccactcattctcattaccagacggaggccggcatggctcgcacgcaccagtgcactgatcgaaccgcagctgattcggcgcaggctggcgctggcgggggccatgtcggccttttggctgccaaaaagcacagtcgcaggctgatggtcaccctcagcctgtcggccagcgtcttcctggtcgaggtcgtcggcgccgctatgacccacagcctggccctttcagtcgatgcggcccatatggtcactgacatcgccaccctgggcgcctccaccctgaccgccgtgctcatgcagcgaaggcctacggccagacgtacctggggctgggcccgattggaggtcatcaccgcggccgtgggttcgatggtcctcttcgtcgtcggggtctatgcgctggtcgaggctggtcgtcggctcttcggggctgaagcccatcaggtcaggacgcccgctttcctgctcttcttcggtgtcgtaggtgtgctggccaatctgagttccctcttggtgctcttccgtcagcgtggggacaatctcaatatgaaagccgccttcctggaggtgatgaacgatgccttgggctcgttcgcggtcgttgtctcggcggtggtcctgctgctgaccggctggggcgctttcgacgcggtcgcgggtggagtcatcgcgctgatgatgattccacgttcgctctccctgctggtaagcagcgtgaaggtgctcttggagcagacgccggacgatttggatatggacgaagtgcgccggcaccttgagggggtgcctggcgtcgtatccgtccacgacctgcacgccagcgccgtttccaccggcatgacccagctctccgcccacgtcacggtcgagactggcacgaccatgcggaaggcctgcgaaatcatggaaagcatgcaggaatgcttgcgcaagcactttccgatcagcgtggagcacacgaccttccagatcgagccccagggctaccgggaggatgcgggcgaacacttggagatgtgagccgtatgccggctgctgcgctttcatgggcctagacgcgcttggtcccgaggccggtcagtcaagcaaggcgcctcagccccctagatgcgacgtaggactgtgacgaccttgcccatgattgtggcttccgagccgtcgatgggggagtacgccgggttgtggggcatcagccagacgtgcccatcctcacggcggaaggtcttgactgtggcctcgtcgtccagtagggcggcgacgatgtcgccgttctcggcctcggactgctcgcgcacgactacgaagtcgccatcgcaaatagccgcttcgatcatcgaatcaccatgaacctccagcatgaaaagctggccggaaccggtcaagcgctcgggcaggcgcatcacatcgtccacatgttgctcagcggtgattggctggcccgcggctattcgcccgaccagcggcacgtcacgggagcgctcgatggcctcatcgcggccctcgatgatagcggggaagtcgatgatgacggagcttgagcttgtgccgtcagcggttggctctggccgctcaaccaattcaatggcccggcctttgttggcgttggtgcggatataaccgagctcttcgaggacttgcagctggtgcttgaccgacgatgggctcttcaggccggcggccaatccgatctcccggtaggagggtgcgaagcctttggaggcgaggtgggtgcggatggcctccaggacgcgcgtttgcctagcggtaagggacggttgaccgccaggttgccggacgctatgacgcgccgcctcgccgcctgtgaaggggatggtgcccacagtgactcctttcgctctttgcggaagtatagccgaaaaaacataagaattcaaacaaatgttcgaacaaggcttgcgtctgggctcgcctcgcggcaagattagaacatctgttcgatagaacaaatgttcgcaaaggagtcgagcatgagcgcagcgatgatcacccgggtgaatccagggtctctgcccaccttcggtcggcgttccagcgggcgggagccgtccaggttccgccgtctgggggccatgatcctgggtctggccctggccctgagcggggctggactggccatcggcaatcaggctcgttcggacgcggtcgttcaggaggtcaccgcttacacagtgcgtccgggtgataccttatggacctacgccaagatggtgacgcccgccggtggggatgtttccgagaccgtggaccaattgatggagctcaacggcttgagctcacccaccctccaaaccggccagcggctcgtcgtgccgaagcgatgaacgcccgcctcgactcgtcgaggcttctttttgcgcgccaagcgggctatcatcggttggtatgcattgtcctttttgccagaacccagacacgaaagtcgttgatacccgcatcagcgacgacggctacgccatacgacgacggcgcgagtgccccaggtgctccaggcgtttcaccaccattgagacctcggccctgctggtcaaaaagcactcaggcaatagcgagccctttaacagggacaaggtcatagccggcgtacgcaaggcctgtcaaggtcgtcacatcgaggaggacgccctcaagcagctggggcagcaagtcgaggaggatttgcgctcgcgtggtttggcccaagtggactcagaggaagtgggcaaggccatactcggacccttgcgcaagctggacgaggtcgcctacctgcgtttcgcctcggtctaccagagtttcaacggtctggaggacttccaacgggccatcgacgagttgaaggccgaagacgaggccgacctgcaggtggccgagggccgctgaaggtcgttgggtttggcggtagagaccagcgtcttcctcagcgttcttcgccttccttgcgttccacgatgaccagctgctgggtgggccgcgtcatcgccacgtagatgtccgatgccgccgtcaggcgggagggggcctcgtcggcgatgcgttcggggtcagtcaggacgaccccgtcgaattccaaacccttggtccctcgcgtgtcagtcaccaaaatttggcggtcccaggaatcctcggcagctaaacggtcggctgcttcgccgcccgcggaagctcggtaggccttgcccacggcggctttcaagggggccacttggtcttgggagccgatgaccgccacccgaccggtgccgtcctcggcaatgaacctgccggccatttcggctgcggcctgggcggcggcttccaccgcaccgttatcgtcagtgaccgtgattcggcgcacagcatcgggcacggtgcgcacggccttgagcgtggagacgcgcagcccctccgagcgagcgtattcgccggccagctccgaaacctccctggggttgcggtagtcaatcgtcaactcgctcaggtcccagccatcttcgccgaaaagctggttcatggtcctttcccaggagcgggtgcctcccaaggccgaggtctgagccacgtcgccgacaatcgtgaatgagcgcgaagggcagcgacggatcaacatccgccaatccatgctggtcagctcctgggcttcgtcgacgacgatatgcccaaaggcccactggcggtcctcggccgctcgctgggctgccgcctgggagtccaaaccgttgatgttgtccaagagcatccgcgaggtcaccagcccgttgcctattccattctgggccagcgtgtccttggcgaactgttgttcctcggcctgctgtgaggcctcggccgcctgcctggcggcctgccggggatcagggcccaggagctccatcgcctcgtccaacagagggatgtcggagactgtcaagggcgatcccttgggtctcgtcagggcttccacctggctggggctcagccaaggcgccagtcgagccaggaaggctggccgggaccagaggttctccaggagccactccggccgcattggcagccaggccaggttgatcgccttgcgtacggggtcgctcaagcgcagaagggagcggacccgggagagctcgtcgctctcgggtgtgtagtccaggctctgcgcgtagcggttctccatcgtttggaggatggacttgacgaaagtctcgcgggccttattgtggctctggcgcgttcgccgggcatcggtcaaggcctgctggacgtcaaccgccagcatggggacggcgatgccttcgatccgaacggtcggcagctcggctggcacccgctcccggctgcgaacggcgccggcgatgacggaagccatccgtccatcgcccttgagcctggccacttcgggtctgtcgttcgcttgggccactacccctgggatcaggtccgctatcgtgcggctgagcactccggtctcgcccagcgagggcaggacctgatcgatgtagcgcaggaagtcaggggaggggccgaccaccaggacgcctgaccgttccaaggtggaacggtgggtgtacaggagataggccgcccggtggagggccacggcggtcttgccggtgccagggcctccttggacgaccagggcatgggccatgtcggagcggatgatgcggtcctgttcggcctgaatggtcgctacgatgtcggtcatccgcccggtgcggcggctggacagggtggccaggagggccccctcgccggccagggtgccctggttggcggcctgacccacctcgggcgaattcaggtccagaacctcgtcttcgatgctcgtcacggtgcggaagctcaggctgatgtgccgacgcaggacgatgtcgccgtgggaggagggcgtcgcctcgtagaaggggcgggccgcttcagcccgccagtcggtcaggatcggatcgtggctttcgctggacaggccgatgcgaccgatgtagcgtcgctggccgtccttgtcgtcgagccgcccgaagaccaggcgatcctcgacggctcgtagttgggccagccggtcctcgtacagggaggcgaaggagtcgcgctccgtgcgctgggtgggggagccgtgggagccagccgcgcgcactgagtccaggcgggacctggtttgggtgcgcaaggcgtccagacggccgtaagcgcggtccacggaccgctgttcgtcatggagttgtgaggaataggttgacatgcgcttcctgtctgttcccatgcgcgctcaaggcgcgaagacgcttcaaaccaagttattcagtgtatcgtctggcctctacttccccacccctgctccgtcgcctcaggggaggggcgcggggctgatgggtcggcatgggcggcgcgtcaggctttgggcttatccgaggtctttgaccgcggtttgaggttttcttcgcctcagtggtggagatatggctaggaagtggtagaaaatggtgataggtggggtagagtggggaatattgcgtttgggggcgctcggtctggggcgcagacgcgatacaacgggccaacaatgccgaggaggtggcagcgatggtaggacaggaatacgaccgtcccgtatcgccgaacccagcctcggaacgcgatcccgagccactccagcccttgcccctgctcctaggcacttacacgccgaaaatggacgccaaagggcgcctggccctgcccgccaaattccgcaacaggctgggcgcaggcctagtcatggcccgaggccaggagcggtgcgtctacttactgccggccgacgaattccggcgaatcgccgtccgcatccagcgcacttcgatgggagaccgctccgcgcgcgaatacctgcgcgtcttcctatccggcgccgtggatcaggagcccgacaagcagggacggattctcgttcccccgatgctgcgcgaatacgcccatctggaccagtccgtcgtcgtgatcggcgtgggcacccgggctgagatttgggaccaggaatcctggcaaacctatctggccagcaaggagcagggctactcagacatagcggacgatgtgttaccggcggtggacttctgatggcggggacaagcgagaccggaatcgccagcggttcctcgccgctggggccgatagagaccattcacgccccggtgctgttggacgagtgcgtcgccctggtcactccggccctggacggtccagatccctgggtcgtggattgcacgttggggctcgctggccacgcctgcgccttcctgaaagcggcgcccgccgcccacctgatcggcatcgaccgtgaccaggaggccttgggtctggccagcgaacgcatggcccgggaagggttgggggaccgcttcgtgcccgtgcacgccgccttcgatcagctggaggacatcttgaaggaccggggactgaagcgggtgagcgcggtcttcatggacctgggattgtccagcctgcaaatcgacgaacgctcccggggcttctcttacagccaggacgcgcctttggatatgcggatggatccgagccagagtttgaccgccgcccaaatcctggccgattattccgaagaggacctggcccggattttccaagactacggggaggagcaccacgcccgacggatcgcccgggcgctggcccaagcccgccaacggcagccagtgcgcacctcagcccagttggaccgactggtcgaccaggccgtaccccgcgcccaccgggctcccggcaaccccgccaagcgggtcttccaagccttgaggatcgaggtgaacggcgagctggacaagctggtccgaaccttgccccaagctgtggcccggcttcgggtcggcggccgcttggtcgtggagtcctaccactccttggaggaccgcagcgtcaaacgtttcatggcctctgggctccaagccaagctgccccaagggctcccggtcgtaccgcagtccgcccgccccgtcttcctggacctgacccacggcgcccgcaaggccgatgccgatcaggtggctgccaacccccgttccgcctcagtgcggttgcgggcggtggaagttagccgacctataccggccgagcggatcgaacgctggcgggaggagtccagtcaacccgtctaccgagccaacatgcacccttcaaggagacgatgatcatggccgcttcagcacgttccgtgcgttctaaaaccgcgcccgacaagcgccgcccagccacccaggccgagccccgccgtccccaactgagcctgatcgaaggcggacgctccgcagccccggacggttggggggaccgcgctcgccgtgtcatcacctgggccggcacgcgctccacgccgctgattcagttcgtgctttccgcggtcttcctgatggcatgcctgctgggctccctcctcctgcgcacccagatggtccagaactcgttcgaggccagcgccgtgcaaacctcgatcagcaagctgacccaggatgtgcaggatgaccaagacaagttggatcaactccaagcctcgctgcctgacagggcccaacagatgggcatggtgccccagcaggggaccaactccatcgatttgaacgggtaccaacccagcccgcagatgcagacgaagaactctcagcagggccaagcccaggttcaggggaaggcgccgacggatagggctggccagcggtgatccgcctgccagggggccagggcccaggggcatccggcttccccaggcggtcggcttccccctcccgcccgcagtccaatcccgtccaggggcggggcacccgtggcttggacgcccgttccttcgccatacgctcgatagtcgtcgcgctcatcctggccttagtgaccgctgtcgccctgggcaaactggcctggatccagctcttccaggggcaggccaccgccgaggcggcgacccgcagcaggaccgtgccccacaccctgaaagcccagcgtggacgcatccttgatgccaacggcatgatcctggcccagagcgtggaacgctacaccatcgtcggcagccccaaggccgccgccgacttcataccagtggattgcaccaagcagaccgagggcaactgccacgccatcaacggcaagccggtgggcgcgaccggtccggctgccgtggcgcgcatcctggccccgaccctgggcatgaaccagatggagctcggcgccaagcttgtgggctccaacagttacgtggtcctgaaaaaggatgtgacccctcaggtcaagcgcgcgatcgataagctggggctggccggcgtgatttccgcggagctgagcaaccagcgctcgtacccccaccgcgacctgatgggctccctcctgggcggtgtggacgcgaacggcaagggggtggccgggatcgagtacatggaggacgcggccctgaccggtaaggacggatacgaggtctaccagcagggcatgtacggccagcagatccccggcactgagtccaagtcccagccgccggttgacggcaaggatgtgcgtttgaccatagacggggacgtgcagtggtacgtgcagaaggccctggcggacggcaaggccaagtaccatgcgggctgggtgatggccgtggtccaagagccttccgccgggcggataatcgcgctggcggacactgagagcaaggcggccggctccgctgaggccaagatgaacccgccgctcgtcgtcacgcagaccttcgagcccgggtcgatcggcaagacgatcacgctctccgggatgctccaggaaggcacgcggcagatgaccgacaagttcaccgtgcccgaccggatcaaggtggacggccaggagtatcacgacgcgaccgagcatgggcccgagcgctggaccatggccggcatcctgcagaattcctcgaacgttggcatggtaatggccagcgataagtacaccgaccagcagcgctacgaatacctgaccaagttcggcatagggcagtcctcagggttgggcctgcagggcgagtccaagggcctgctgacgccgccgagcgcttgggaccggcgcacgcgcaacacggtcctcttcggtcagggctacgccaccaacgccattcagctgaccaacgccgtcgccaccatcgccaacaagggcgtgcgcaaccagcagagcctgatcaagtcggtttccgacgaggacggcaagcccgggcagtcgccctccagccaggcaacgcgcgtaatcgatgaacaggtggcggcccaggtgatgaacggcatggaatccgtggctgacaagttcaagaacgtggccgcggtggacggctaccgggtggcctccaagaccggcaccgccgaggtggctggccaggatggcaggctcacctcgatcatcagcgattgggtgggcgtcataccggccgacaatcctcgcttcgtggtcaccgtcgtgatgaaggaccctcagggcaccttcggcggtctgaccgctggaccggtcttcgctcaaattggtgaattccttatgcagaaatatgagctgcctccctcagccccgcgcacggatgctatccctgttcaatggtgataagcatgagagggagcgcgcctgatgctcgcgagccctatggcggagaggcggagtcatgagcgcgctgagcgagtcgatccgccaacggatgaccctgggctatttgcgtggccactacggtctggagctcctacccccggcggctgaagatgtgaccgtgacctccttggccgacgacttggcttcggtacggcccggcagcctctatatgccgtacttacggcccaatgaggccgagaccactgcggagggtctgccatccgacgctggcctgggcgacgatgcgcagtccggccgggagaccaaacaggggcggcacgctgcgcctgcagggccatctgttcaggtcgggtcgcaggagcagggcgggtcacctgtccagccgacgccaaccaccgctgacgaagcggcgctggtcgcgcaggccgagcttgcgggcgcctacgcggtcctcctgcctacccgcagcccagggcaggagactcctagcgccgacattccgttgcttattggcgacttggcgcctgaccaactgggccgaatcctgtccaatgccgctggcgacccttccgcgtccttggcggtcttcgccatggtcggcgacgatgtgtacggccaggccgcggatctggctgacttcttgcatacgctgggaaatccggtcgggatgatcgccgcctcaggctcagcatccctggaccgccccctggatctgcaggggcccttgagcatgttcgatctgcaacgcgctctcgccatctgtctggaagacggggccgcggcggtcgtgattgaggccgacccagccacgttgcaagaggatgccttacgcggcgtgcaaatagacgtgctggctttccctgacgatgccggaccgtctggtgggcccgtcggagccctggcccgcttccatgacggcaggcggggcagggcttccgcggccgcccggcgctatggattctcattcgggggtagcacgcaggtggccaggcggggcgatgagtccgacgagatggcccgccaagctcttcctggcggcgatcaggcccatctcaaccagctctcattgaatattgcgatgactgtggccgctggtgtcaaacgcagtcacatccgcagcgcgcttgaagcctcccaggagctttcctaggggcgaaaggccacgagaacatgcatgtacggaatggacccaggtccgcttggcggtgcgatggccgatgccgcgggtggtctggaagggacgagaggtgacgatggaaaaggctgagcggccggtgctgatgcccatgaccctgaagcaggtggcccaagccgtccacgggcggattacgcccgctgcggcgaagggcgggctggacctgccgatagcgaatgtgacgacggactcgcggcaggtgggtccaggctccctgttcgtggcgatagccggcgaaagggtggacggccaccgcttcctgggccaggcagccgagcaaggcgccatcggggccctggtgagcgaggagcaggcggatgcggacctgccccaggtcgtcgtcgaggataccgtccaagccttgggtcagttagcggccagcaatgtggagcgccgccgggctttggacgctcccttcacgctggtggccatcaccggatcagtgggcaagaccacgaccaaagacctcctggccgccatgctggctaagctcggacccactgtggccccggtaggctccttcaacaacgagataggcctgcccctgaccgccctgcgcgtggggcctgacacccgctatttggtggcggagatgggcgccagccaagtgggcgacatcgcttacctgacatcgatagccccgccagatatagcggtggtcctcaaagtcggtgtggcgcacctgggcgtgttcggctcggttgaacggatagcccaagccaagagcgagctggtacgagggctgcgcccgcatggcctggcggtgctcaacgccgacgacgagcgggtggccgcgatggcccagctggcgcccggccgcgtcctgcgattcggcttgggcggagctgagcggcctgacgatccaggtctcgacatgaccgccagggacatcaccaccgacgacctggaccgtccctccttccagcttgaggccaggggagagcggccggtcgccgccagcctggccctgagcggcgagcacaatgtgatgaacgccctggccgcggcatgcgtggcacatgagcttggcctgccgctggaggacatcagcgcgtccctgagcgcccaaggtaggcgcagcccccaccgaatggcggtcagccaggtggaggaggatggggcgcgcttcacgctgatcgacgactcctttaatgcgaatcctgactccatgagcgccggtctgagggccctggcctcgtggaaggaaccaaccgggggccaggacggcgcggcgcaagcggagccttaccgggtcgccgttctgggcgggatgctggaactgggcgagggcaccatggacctccaccgtcaggtgggcgccctgtgcgtcagcctgggattagacgctctggtggcggtcggcggcgagcgcggccagctgaccgacatggctggcgctatggtggagggggccaggcgggcatccgccgcgcaagggtccaagcatgccgggatgcggctcttccaggcgccggacaccggccaggccgaccggttcgtgcgtgacttggccagcggccatcctggttgcgtggtcttgctgaagggctcccacatgtctgggctggatgccctggctgagcgttggcagagcggaagattcggagagcagcagtgatttccctgatcataggcatcatcatctccctgatcgtcaccttcggggggacgcccttgctggtgcgcctgctgcacgagcgtcactacgggcagtacatccgtcaggacgggccccagtcccacctggtcaaacgcgggacccccacgatgggcggattgatcgtcaacctggccatcgtcttgggttgggcgggctccgccttctaccgctacctgtccaggggcgataagccttccctatcggctatgctggtcctgttcgccatgctttcgatggggatgctcggcttcattgacgacttcactaaggtacgcaagaagcagaaccttggtctgtctgtggccggcaagttcataggtcagttcatcctggccacgatttacgccgtcctggcgcttctgctgcccactaagaccggtttccactccgcccaggcgggcatatcgttcgtggaacgcccgatcatctccttcgagttcgccggacgcgcggtggccatcatcctgttcgtcttgtgggtgaacctgttgatgacggcttggagcaatgcgttcaacctgaccgatggcttggatggcctggcttccggttcctcgatgatcgccttcactggttatgccatgatcgctttctgggagtcctaccatgtgaggggcggcagccacgccggtcattcgtacgcggtgtccgaccccttggatctgacgatcatcgcctgctgcgctgccgtggcttgcttcggcttcctgtggtataacacgaatccggcctccatcttcatgggcgatacgggctccctggccctgggcggcctgttcgcggccctgtccatcgccacccacactgagcttctggccgtgattctgggtggcttgttcgtgatggagaccgcctccgacgtgatccaggtgggcttcttcaagatgacccacaggcgcgtgttcaagatggcgcccatccatcatcatttcgagctgctgggttggcaggagtccaaggtcgtggtccgcttctggatgatcgagttgattttcgtgctgatggccttggtcctgttctacgcggattggctggccaggtcgggcttggccctatgagtcctgggcgcaggcggtttgggcgaacggatgagtgagccgcgtggattatgtggatgaacctggaggatgcgacgatgaatatcagcgataagcgtgtgctggtggctggattgggcgtatccggccgcagcgcggtccaagccttgcaggggagggcccgggcggtgaccagcgtggatgaacgagcccaggacgctgacttatcctccttcgaccaggtggactggagccaggtggatgtggtcatgacctccccggttttcaatccgcgcacccctttcatccaagaggcccaggagcgtgggatcccggtcatcagcgaggtggagctggcctgggacctgcgtgcgcccgccgccaagaccgggcggcccgccccctggatcggcatcaccggaacgaacggcaagacctccaccaccagcatgaccgcggctatgatgagttcttcgggctatgacgcgcctgcggtcggcaacatcggcaaggccgtctcccaggccgccctggaccccagccacgacgtcctgtgcgtggaattaagctccttccagctccacttcaccaactccctggccctggagtgcgccgccatcaccaaccttgcggcggaccacttggactggcatgggggcttcgaggcctacgcggccgacaaggctaagatttaccggggcgtgcgcaaggccctggtctacaacgctgacgaccggcgggtgagcgtgatcgccgcagccgcccagttggccccaggttgcctgcgtgtgggcttcacgctggggcagcccgaagcggggatgatcggcgtctcggatggttggattgtcgacatgagcggagtggccggtggcccggtgggccaagccgagcgcatcgcccccctgcgcggcttgcaggggatgagcgagccggacgggcgcgtttacccccacctgctggccgatgccctgtgcgcgttcgccctggctcttggcgcgggcgccgatcgggccgccgctaccaaggccatggcctgcttcaaaccaggcgatcaccgcatcgaaacggtagcccagctaggagcgggcgccgatgccatccgcttcgtcgacgattccaaggccaccaacgctcacgccgcccgagcctccctgtccagctaccagcccgggtccgtggtctggatcgccggaggcctggccaagggagcgcgtttcgaggacctagtggccagccaagcctcgcgcctggcggctgccgtcgtcatcggccgcgatcccgagcccatcctccaagccttgtcctcgcaagccccgaagctgccggtagagcgggtggagccagaccccgccgattcggtcatggcccgggccgtcgcggccgccggccggttcgccaagccaggccatgtggtcttgttggcgccggcctgcgcgtcaatggatcaattcaagtcctatgccgagcgagggcggatgttcgccttagaggccgaacgatgggtcaatggccatgaggctgcctgatttcaacctacaggtcaagccccgatccgcctcctctggcaaggggcgtaccagtgatggcgggcgtgtgaggcgaccggcgggtcctgcgaaaaccgcaagcaaaaccccggcagcgcgtgcgcaaacctcctaccagggcgtccgggccctgctcaaccccttgtggtgctactacgggttcatcaccatagtggtggccctgaccgtcttcggcctgatgatggtcttctccagttcctccgtcgatatggtggcccaaggcaattcgccttggagtcaagccatccgtcagtccggcttctgcctggggggtttcgccctcgccttcgtggccatgcggttcaaggcctccacctaccgcaaggtcagcctgcccgctgtgtggttcggcctcttcttgcaaatgctcaccttcacccccttgggtcgggcggcgggtggcaacgcaggctggattttcatcggtggcttctccttgcaaccggcagaggtgttgaaactggccctgtgcatttggctgcccggcgcgctgatcgacgcggccgaccgcagcgggcagggcgagggcctgaaggcctactggcgtccggcggctggtttcctggccgcctttggcctgatcatggcgggcaaggatctgggcacggccatgatcatcgtattcatcggcctggtcgctttcttcgtctcgggcttcccccttaagtggttcttcactgccgcggtcgccggcgtagccgggattatcggcttcttcgtcctggggcacggtaaccgcatgcagcggatcatggccgcatacggcgagtgctcttccgacgatttgaaaggcgtgtgctaccaatcagtccacggcttgtacgcgatggcatcgggcgggttgaccggcgtcggactgggcaattcgcgtgaaaaatggaactacctgcccgaagcccataacgacttcatcttcgcggtgatcggcgaggaaacaggattcatcggggccgttatcgtcattctggctttcgtggcggtgggttggtgcatgttgcgcgtagccttgaccacgccggatccctacgctcgcatagtcttggtctgcatggctttctggatcgtcggccaggccctgatcaacatctccgtcgtcctaggcctcctgccggtcatgggcctgcctctcccgttcgtctccgccggaggcacggccctcgtcctgtgcttggtggcggcgggcgtggcggttccgatgatgcgaacccaccccgacatccaagccgcggtctcgaagatttaaaggctccgatcgccccggatcattcgtcagtggtccggctatgctcgtatctggacgattctggtggaggagagggcatgagctcacagtcagcggttcacgtggtcttagccgggggcggcacagcgggccatgtcaaccccctgctctcggtggcggcggcgatcaaggcggaacggccccgcgcccgcgtatcggtcatcggcaccgcggtcggcctggagcaacacctggtgcccgaggcgggcctcgacctcgatgcgatcgacaaactgcctttccctcgtaaacctaatatgcaggccctgcgcttcccgggccgctggaggcggcaggtgaggcggacccggacgattctgcaaacccgccaggccgacgtggtggtgggtttcggcggttatgcgtccgcgccggcctaccgggcggcccatcagatggggctgccaatcgccctgcatgagcagaacgccagggctggcatggccaacaagttgggcgcgtgctgggctgattacattggcaccgcttacgattgcactggtttgaagccgcgtcgcggggccaggatcgaacgggtggggctgccattgcgcccggccattgccagcctgtgcgagcaggtggagcggtcgcgggagcaggcgcggcggcaggcggccgccagtctagggctggatcccgagcgcccggtcctggtcgtcaccggcggctccttgggggccttgagcctgaatcgggcggtcagcgctgcggctccggctctcttgcggacggcgcaggtggtgcacctgaccggtaagggcaaggccgaggctgtgcaggagagcgtggctaagctagcgggggacgaggccgtcaacgacctggacccctcgcacgcgggccggggtgactaccatgtcgccgcctacttagagcgcatcgatctcgctttcgcatgcgctgatttgattctctgccgctcaggtgcgggcacggtcagcgagctgaccgccctgggcctgccggcggtctatgtccccctgccggtcggcaatggggagcagcgcttcaacgcccagccggtcgtgcaagccggaggcggcctcctggttgaggatcacgagctgacctccgactgggtgagccgcgagttgccgcccctgttggccaaccaaccccgcctgcaggaaatggggcgctcggcatggtcgtacggcattcgtgacgccgctcaggccatggcccacagggtcttggacctggccgacgcgcacggttaggggactgagcacaggccttgtgagcgttcctggcggaaggtcgccaaaggcagccgactgagcaggccgacaggcataatggatgcagatgacgatttaggagatgcctcttgtcccagcagtccactagttcattgagacccgacgcgctcgaccccaccagccgggttttcgaatcgggcaagcccacgctccaggacttgggccgtacccactttatcggtatcggcggcgccggcatgagcgtcttggccctgatgctcaagcaggcggggctggaggtcaccggctctgaccggcagtcctcagccaagacccgcgagctggagggcttgggcataccggtgtccatcgggcaggcggccggcaatgtgactggggcgcgcacggtggtctggtcctcagccatcaagccggataacccggagatcatggccgcgcgcgccaacggcagcgtcctggcccaccgctccgatatcctcgccctcctgctggcctcccataccggggtaaccgtggccggagcccacggcaagaccacgaccagcgctttgctggcccatatcctgtccactgcgggccgcggacccctggctgacccctcctatgcggtgggcggttccattcaatccgcccaaggcccgcaggacgggggccacttgggctccggccaggttttggtggcagaggccgacgagtcggatggctcctttgagaaataccatcctcacattgctgtgatcacgaatgtggaagccgaccatctggaccactatggcagcgccgaagccttccaagcggccttcgccgagcatgcgcgccatgctcaaggctgggtcgtggtctgtggggacgatgacggagcgcgaagcctcctggcgcacttgcgcggcgactgcccggcccgggtggtggtctatacaacggctgacgaggatcagattgacgaagaaggctgggattcctgggcccatgtggcccgtatcgaggctgagcgggagagtgccggctcgggtgccgaacgcttccaactggagcttccccccgggttgggggatcgctccgacgaggacgtggacgggcggaccctgtccgtcgagctggctgtgccaggcatccacaacgcccgcaacgccagcgcagccatcatcgcggccatcctgcttggcatgaaccccaccgatgcatgcacggccgcctcttccttccagggcgcctcccgtcgtttcgaggtcaaagggcaggaacgcggcgtcaccgttgtggacgactacgcgcaccatcccaccgagatcgccgctcttttggcggctgcccgccgccgttacccgcgctcgcgcatccacgtcctcttccaaccccacctgtattcgcgcacgcgatttttcgccagtcagttcgcccaggccctcgcggcggcggacgatgtggtcgtcactggcatttacccggcccgcgagcgccaggaggacttcccggacgtagggccggagacgattgtgcgcaactggcagcggctggagggctcatctaaggctgattcagcggggcagggccggggctgccgcatggagaccgtcgagaatcttcgggaaggcgcggaacggttggcggaccgcgctcgcaaaggcgatgtgataatcaccgtaggggccggcgatgtgacgcggatgggcgcagtgatcctgaaccgcctggccgatgaacccgagcgcggagggaagagtcctacatgagtcggcgtattgcgagctcaggcgcttcctcgggcgagggggaggaggttcaacgcggtcaaggagcttcctccagtcgtttggccgccggtcgctcagcagcgaatcgagcggacaaggcaggggcgcagaaaggcaagccccggctccgccgccgttcagcgagcggtgcggctcagcgctcgaagggcgctcggaaggcctcaaccacgcagggtgatgttcccgtgcgcatcggccaaggcgcatcaagggcctccaaagcctccagggcgtccaaagcgccgaaacgcgccttgcggaccgacggcatcagcaaaggcgtaacgcgttcggctggtggtcgcgagttggcccgccggacgcgcgaaccccgcgaagtggtcggatcaggcaccggcaccggcccggtttcagcgcgggcagaccgtcgggtcgccagcggccgcaccaggtcctcttccggtgatttcgtcgacgcgcgcgcccttcagtccgacgatgcgatcctggagacgatgaccagcccaaagagccaaggcatcggcgtcttcgtcaaacccaaggtggtggacttcaaagcccgcttgcttgaacggcagagggcccgcaggcgtacgctggccattcgatggggcgttgcgctcgcctgcgtcacggcggtcaccgccctggtctggctcctatgcttttcgccagcgctggtcatgcaagcggaacatatccatgtctcgggcggtaatcagtgggtttccaacgaggaaatagttgatattgtcaggcgtcaggacgggcgctcgctggtcctcgtctcctcaggtgggatcgaaggggaaatcaaggccctgcccggggttaccgacgccaaagcctcaaaacgtttcccccatgggatggacgtgaccttcaaagcccaggagccagccgcggtcctgaagtcagcggacggcaagattaccgcggtcgacaagaacggtcgggttctcaatgcggtcggcgcatccgccaagggcatcccgcaaatcgaagtgagctcggtcgacaagggagtgtccgatcacgccgtgcagcaggccttgaagattctggccgcccttcctgagccgatgcggcaagcggtcaccaaggtcaccgccaagacccaggattccgtcaccaccgagctggacggcggtcagcgcgccatcatctggggcgatgcctcagacctcaaactcaaaatggcggtagtggacaaaatcatcaatgacccttcgaagataggagacaaacaccaggtcgatgtctccgcccccctgcggcccatcatcaaatagcaagtaaaccgcgcttatttgcctgccatcagcaggtcggtgtcaatcgggatggtgaccggaccatcgttgagcaagcgcacgcgcatatgcgctccgaaccgcccggtctttacggccagcccatgcccctccagcgcccggttgagctgctcccatatggctttagcgtttccaggttcgcccgagtccacaaagctgggcctgttgcctttcttgatatcggcaaagagcgtgaactgcgagactgacagcacctgaccgcccacgtccagcaccgacttgttcatctttccgacctcgtccccgaatatgcgcatattcgcgatcttgcgcgccgcatactctacctgcgcgtccccgtccgagtccgccacgccgaccagcagcagcaagccgtggcctatcctctgctcctcgaaagacgtgtccggtttcccgctgatttcgtcgacgacatcaacaccggcttcgctcacccgctgcacgataatcttcatgccttaagtctaagccagccccgacccgatgatgttccgccttgaggacggccgccagccggtttgcaagcttgatttgtcaaggccgacagtctcccgtctcctgcgattctcacgtgaccaaggactggtgcgactggagatagccgatcccgcgaaggaccgcgaagccgctgcatctcgtttggaggctaagtatggtcttaaaaaagccttgctcgtctacgacgcgtcgcacgaccggaggatactcaacgagaagttaggcgaacgggcggcgggatacctggcctccattgtccgagaccacgatcgcataggcatcagctgggggagggccctggaggaggtggccaatcatctgcgtcccagcagctgcaaggatgtttcggtggttcagctcaaaggcagcgtatccgtctcggatatgaacaactatgccaacgatatcagcaggaacttcggtgccgccttccagaccaacaccttggcgctgccattgccggtgatcttcgacagcgccgtgaccaaggacatcgtgatgcgggaccggttcatagcggatgtgttcgctgccgggaaagcgaccaacatcgccatattcacctgcggcaccgttcgaaacgatgccatgctgttcaagctgggctacttggataagagcgagacagcgcgcctgcaggcccatgcggtcggcgatgtcatctcccacttcatcaccgccgacggctccctggctgacgctgacattgatgctaaaacggtgagtttgccccttggcgaggtgaaggagaaggagtactccatcttggtggtcggcgccgcgcccaagatctcggccatacggggcaccttgctgggtggctacgccaacgtcctgatcactgactacgaatccgccctgagttttctggcctagtgcgatgccgcgcgaccctagtgactccaggcgctcgctgccatgcgcatgagagcgtccgtcggtttcgtgcggtcgatcgatgggagctttccggcgtccttgccgaaggctgacttggataggggcgcgggaatacatggaggcgggggagtgtagggtatagtggaaggcctggcggcaacgccatgtttgataattgaatattggggctgatcggtttcgacggtgacctgttcgtcgcagggaagcgtgccgagaacgcgggggtccactcgttaatgccctcccgcaacaatcaagtgctaaatctaaccgcactgagttcgctctcgctgcctgagttttaaaccaggattaaccagcgagctacggctccgttcactctctttcgtttccggggagatgctgagcgtcatttaggagacttgcttgagctgccgcgtcacaggacggctcagggacttttactgtgactatgcccgccatccgccgtctgcggtatgggtgggggcagaaaaacagccatacggccagcagactacgcacgtagaagactgagggtacggtcaccggaccggggttcaattccccgcagctccaccaacatcgaagcgccatcccgtgaggggtggcgctttttcgttgcaatatcagtagttttgagccattcttgcgcgcgctcctataatgggttacgcggggttaaagaggcttaaaaggggcttctaattggacagctaattggacaggattggtcatgggaagaacgagggcattcggcagcatcgcctacaagccatccaagcaacggctcacacggatcgtggcatccttcctgaccccgcaggaagcgttcgccacatggcccaatctggccgagcggcaaagcaagtcatttccgcctggccaggaggacgaggcgcgagcctggttgagcatggcgcacaagaagatagaggccggagtatgggagcctcctgtggcagtcaaacaacgggagaagtcggcccgtcttacactgggggagtacttcccacaatggctcgaggaccgcaccttcaaggggcggccgttgaaagcaggcacccggtaccggctgaggaaggatgttgagaaccacattctgccttggttcggtgccatgcgcctcatcgacatcacccaggccgaaatagaccgttggctagcctccatgcccgcagagcagaccgctatgaagtccaacgcgttgaaggcgctgcaagccatcctcagatccgcaagccaacccggcctgcacggagagccagccttgattcccgtgtacccgtgcaccaagtccctgcccaagcccgaacggcgcagccagactgtgcccgccacgccggaacaggtcaaggccatttatgacgccatgcctgaacgctatcgtatggccgtttacttggccgtgttcggtgacgggctgcgcataggcgaggtgtgtgcgctgcaacggcgggacatcgacctcacctcacggacgctgcatatccgtcgcgggcgcgtgaccatggatcgctcgaagacgaccgacacacccaagaccgaccgcagtatccgcgacgagcgcataccgccccaactggttccattgctccaggacttcctcgcggaatacgtaggctcagcgggaacggcatggctcttcccgaaagtgaaggattcttccgcacccgtgcatcccaactctttgcgcgcctggtatgacgacgccaggaaggaagccggccgacctgatctgcgcttccacgacctgcgccacaccggcctgacctggctggcggccgagggtgccaccgtccgcgagctcatggatgcggccggccacgctgacgtgaacactgccatgcgctaccagcattccctcgacacccgaaaggacctgctggccgagcgcctgggcgacaaactcctgccggacgagacgccggagattctgcgagcgcggatcgcagatctcgaaaagaggattcggaagatgcagcgggagaggcgaagcctgcgcgaaaagttgaaaacgctggaggcacaactctagaacgcagaaaagcgcccccgcctccggcaaacccggagaacgggggcgcttggttatggtggttgtctacttgctggcgattttccggacgctagcaccggagtcaacctcgggcaggccggcgatgctggtcagcacgctcagcacggcggccagggccgcggtgccggcgatcaggctccagtccacgccgccgatggtggctgcgctggctgggatcgcggccacggcggcctgggcggcggtcttgacggcgcgtacgcacgcggcccgcgcccagtcggccagcgaggatgctgccggcgggtcaggctggttggctgtcgcgtgttggggcatggtgttggtcatgatggtctccttagaaggggttggcgtcggatatggcgagttggaggcggtcgaggggttcgccgagcatgccggcccagccgtcgtacgcgtcgtaggtgctgccatcgtcgcagcacacgtccagccagccggccctcgcggcggtctgcgcgcggtagtagacctggctgactaggccgtcggggctggtgtagtaacactgcaccccgtcgatggcctggccgggcacgcccgcgcatccgttcacggtgtcgttgatgtcgccgtggtcgatccagtccagccagtcgcgcccggcgtggacgcggtagcgcaactggcctcggtccacgcggatggcgagcaggtcgtggctcgtgcagggcagacccgcatagccgtcagcccccaggccgaaatcggtgacctcgggcagccagccgccgccggccacacgcagtcgatagtggatggggaccgtgagcggcctggtggggttggtgtcaccgctggaggcgggagccgtcggctcggggcgacggtcgggccgtgggggcgtggacccagtgtcgggcaggccacgggctatccggtcgatgcgtccaaggtcatacgtgcccgggcaggcggtgttgaaccaatgattgtgcggatgcaggggcaggtcaccgtaggcggcgcgcaggtcgcgcaccagctccgcgatggtttggtagtcgccgtccgactggcgcgggttgcactcgatgctgatggacttgtcgttgccaccggagccgacgcccaccccatcgccgcacgcccaggcccggtccccgggggcgaccaggcaggccacgcggccggcctcggcgacgtaatgcgccgacgtgccgcgagcgccggacgtgaaggtttggatgacgccctcgaaggtggggttggaggcggggtcgccccaccagtggatggtgatggagtcgattccgtagggccggcccggcgtgtagcacgccgcgtcgtattgggtgatgtcctggtaagccatgatggctcccttccgataggtgaggccgtccctgggattaggggcggcaaaggtgttgcggggccgatcacgcggccagcacgaggatggcgagcaggaggcgcaggaggcggtccagggccatgccagccagccagaccaaatcggtgagagcgacgcccgccagggccatgccggccaggagggtcagggcgatggcggtgatggtgcggcgtctcatgcgggcccttcctggtggtaggggtggtcgtcggacacgttggccaccatgatctgtcggtgcagttcggtgccggtgccgttgcctcccagagcgtggtaggcgtcgtagacctggtcggcctcgtccttgatttcgacgggcatgggccggcctgcctggacgaagcgttcgtggatggcgaccagctcgcctttcatgagggcgcgcatcccttgctccatcgctttctgtcggtcgtcctgggcctgggtctggcgttgggctttgagctccttgttctgccggtattgcaaccagcccacccagatgagggctgcgctgttgatgagggccacgatgattgcgtcggacaggtcgatgggcattaggggtacctttcgctgggtggaaacccacacggcccagcctccgtaatgagcctgggccgtgtgggtttctgatgttgttgtgtgggttacgagagcggcctgcgccggcatatcctgccctttcgccgcggcctgtttgttggcttgtgatgggattacaacgccccccaaatgccggtcaggggcaccgggatcacggcctccagcagcgtctgcataagctcggacatgagtgatgcggatcccccttacacggcggtcagcgggttatacgagaactgggcgttgtagaatttgttgtcgttactcgcgccgaaaatgtcgccaacccaggtgaagtccctgccatcccacttgccctgccacaccaggttgtcgtcggtcaggcccgtgaaggtcgtccacacgcccagacgggaggcgttgtcgatccagaacagcagccgggcaccggaattatgctggggccgccccgcgcgtatgcgcgcgtgcagcactccactggtgaggaccgccgaacccccagctccggtgatgttgtccgtgcccgccaccaggcgcagctcccgatcccgccacatggtgtcgccgccatgcaggaccgccgacgcgatcagcctgccgaacgtgtccgccagggcgtcgcccgggtggatgtccacatagcccgggtccgcgatcccccacgaccaggccccacgcaccgtctgcacctgcggcacctgcaccgcggcccgcatcgaccggtcgtacacgcgcctcagctcgttggtcggccaggacgagtcccacatcgccggcacgaacacgacctgcgcgccggggaacaggtccactgcatgctgcagggtcgcccggatcgcctcctggtaggaatcctggcccgacacgctgccgtcgttgcgcccgccgccgatcagcaccaccgccacccggtccaggctgtcctgcaggtccgccgcggccgtgtccagctgcgccgtgaaccggtcgccggaaccgcccagcatgcccgacccgctcaccgcgtagttacggcactccaggccgagcatgtccgcgcaacggcgcgtcatgctcatggtcgcctggttggaggtacggaagcccgccatgtacgagtccccgacgcccaccaggatcgtgcggggcgtcaccagcccaccatgccaggccaggagtgcgtcctgcgtcctcgaccccttccgcccgatcaggcccgccaaggccgcatccgcctgcaagcccgcctggtcggcgaacgcctccgcctcgtcacgcgccttgaccgcctcatccctcgcctgccgggcctgtggggtgatatcccccacaggccctggaatccctaccgtcttcttatctgtaatctgatcaaccacaaacagctccttctatatgtcaatcttctaaagtccagtagccccagcccagaatttccgtgaccccagctcgactggcgataatcttccacgctcccatccgtcgggcctgccatgccgcgccagtaaaagcgtcaggcggcacatacacggccgccaatccatctaccccgtgcgcgtcacatcctcgctcataccagaactgcccgtctagggagagcatctgataggagcattgccaatctgagaggtctaccgattcgaagggcccattaagcttggactgtcgctgccagcgagcgccgatacggtttgttgcgccgcgtaggagtaggatgtcttgtctgcctatgttttcagctagtactccgttacccataatgctcctctcaggttcgcatgaattgcgtgtaggtgttgagtcgggcggtgttggtggcgaaagctgggtagctgccgttgaggccttgcatctgcagtactacggagatgctgctgggtagggcagtatattccttgttggctgtcaggctgcaggtaatcatgatgagtttgtctgcgactgtggttggtacgcgttctgagagcatgacatcggtgtttacgagtagtcttgccaagcctattggcgcgccttgtgggttttcgcctgatacgtttgcgtttactgagacttgtagcacgcacctgcttgtgccttgtggtactggtatttccaggattactacggtggaccaggtagtgtttaagccgaagtttgacgtgttcttttcctggatgtcaatcactggctgcgattcaagtagtttcttgatctgtttctgctgctcatccagtcgcttcgtgacctgaccgagctcggtgcctgtgggcctgttcgcttcatctttttcgcgctcttggcggcgctggcggcggtcgcgggcgaggaagccgtcaaggttgcctggctggtatttgcccatgatgtttatccttccgttctggtgcgtgcctgcaggtcgagccagtcgctgtcggatgatcctttcacatcggtgatctttaggtgcaagaccctgtctcctaggaagtcgtcctcaactcgtacgtcggcccagtcgccgacgtgcacggggtattcctcgcccacggacaggcctatggtctcgttcatgccggtcccgtaccaggcttgcgctgtggcgtagtgcttcagggtcgctagctcggagacagtggtgtgctcgctgttctttgtctgcaggacgggccagccgtgactgggtaggtcattacgggtagcgcgagccatgacggttttgtcggagcttttaccgcccatagcccacacgtcggagcacatgcctgacccgtcttcctgataaccggtcaggcgcacccgctgaccgggaacggatgcagtccactgccaatgcctgtcagccaggtcgggagtggcctcgagagcgaagcttaagcgcccggccatgtccactgtcgggcggaagcggatctcgtcgccgtcctgcaggtcagctaaatcggatagacggtcagccactgtggctaggtcccacccgtagtaggtgcgggtatggtcgccgccctgcttgctgggcagggtgataggcaggctgccccatttcagcgcctcgctcactaggccggcggcgatgtcgcggtaggagccggtgaaggtcatcgcccaatgcccggcgggatgctcctcgtccacgagcacgtcgccgtcgtggaaggcatcgtccagcgcgtggtcgaggacgagccttttacctaggagcgtccagccgccgccgacgctgagggagagcttgcggctggctggatcccacttccttgatgtgatgaccccagcatgcttgacatcagatggtgcgcgctgtacagccagcagggtcttccacggccgcagcatctcatagagcgacgccccttgtgagctcactgtcatggtagagcccatagtcacatccacttgcatctggccaggctccgatatcgagtccgaccagctgcatgctgcatacggtagccggcctaaatggttgccagtctgcgcagagtaggcgtgcaccgtcaaaggcgcattcatttctgtcacctccaagcaggtcgtaaagatacagtgagctgaccagcaccttgagtttgcacgctaatattgctgatacctgggggcaaggggaaggcatcgtcataggtgaccaggccttgagagggattcatgctcgcgaaggctagatccataggagccgtgctgccactccagctcaccttgcggccagctaggctgagcgtccacccggtaatcccttctgcagacactgtcggccaggtaggagcagaccccgcgttctccacctgcgcgacaccatgcgaagcttcgacctggacgcgtggcccgtatttgagagggtcaggacagtatacgaccagactgaatgtcatcgattgcaggctgaccagcagcgtagatcctgggtcatcagccagccagccggtcagctctcgccagcccatagcatcctcaacccttaccgtcagcggctggcaggcgagcgcgttgatacggtctacgagtctggcgaggctgagtgaggaccgttgcgctgttgcacagcggatagtgagggtgcgtgactctgaggttaggcgcgctggccagtaggagccatcttgctggggtatggcctgggcggtctcccgtggtttcggagtgccggtcagaccatctataccatcctgtctaatccacgcgtcagcccgctggtcgagtcgattatcggttagggtcagggtgtcctgaccggtgatgagttggattctcatatatcacccccatctgcttacagctgcctcagctcgggtatcgaacatggcgaacaacaggtccgggtcggtgcctcgggcgtcgatatccacggtgacctgagcaccagaatttgatgcttggtcaggcccattggggtgcgtgaggttggtggatgcggcatccattgagagagtctgattgctcagggtgagaccagcggctagtttgtcaaaactatggttgacggtggcttggctgtcggagatgcctagggccatgcctcggccgatcatcacgcccacctggtcgcggaagacccgtgatggcgagtggatgcccagcttctccttgacccagttcagggcgtttccggccgcgtcggccgcggcctgggccagttgtttggcggctccggagagtccgtcgactatgcctttgatgatgtttattcctacttcgccccagttgacctgcgcgaagccgttcttgatgccgctgatgatttgcggcagggccgcgagcagcttcggtatggcttggaccaggccgctggccagggtgatgatgatctggatgccggccgagatgatctgcggcaggttctgcgccagcgtgttgacgatgctggctatgatcactggtatctgggacacgagttggggaagggcgttaaccagtccgttgatcagggacaggagcacttggacccctatttggatgatctgcggcaggttctgggtcagcgtcgtgatgatcgcgttgatgatcgtgggtacctgcgccactagctgcgggagagcatccaccaggccttggatgaggccgagcaggatgttcattccgcctgtcagcagcagaggcagcaaggtcgtcaacgatgtcaggattgtgctgataagtgtgggtatttgctcagcgagctgaggcaatgcggccaccaggccttggatgatgccgttgagcagctgcatgcccgccgacatgatcagaggcagctgctgcaccaaggatgtaatgagcgtcatgatcatggtcaaggccgcggggatgatctgcggcaggttctgcgccaaacctcgcacgagcgcggctatgatctgcgcagccccggcgataagcgagggcgcggccgtggttatgccgttcagcaagctgaccaccacctcggacccggatgccatgatctcgggaagggcgtctaggattgtcgccgtgaagtgtccgatcatcgcgggtgcttgcttggcgatggagtcgattgcagtggacaggcctccgttcatgccctgatcaagcaggcccaggccggcgaccaggccggcgatgatggccccgatgccgaagaatttcaggaagttccccggggcgaagaagttgccgaccatgctgccgactttgcctaggcttgattgcaaggggcctgcgatgatgtcccccaggccgccgaagaggttgcccacgcctgacgccagcggggcgaaggcccccttgatgccctctcccacccggccgaaagcggctccgattttgctgtcgcccaacgtgtcgaacgcggaagagaacccttgccccaagcgtgtggagaacaccttgagatgcagatcggctgtactggtcagtttgccgaatccggtgccgatggatgaccccaggccggcaatcgtaccgccgattctcgtgtcagccagcttggagcccaaactgcggaagggggcggtcaacccgtccacgcctttgccgatgcggttcagggcgttggcgaacgggtcgccatcgatggtcatggcctcgcgtagatccttgttgaaatagcccttgaactgctgcagtccacccatagccccctgcaggccttccggcagacccttgaccttgcccagcaggtcgctgatgcctttgtcgccagcgtggcccagcttgtcgaacgctccgctgatggtcttgacgttgccgcccacccctgcgagcacgccgaacccgccggcgagcgatgccaacttgcttgctatgtcgccgatgctggtgctgccgctgttcaggcttgcggtgtaagcgtcaaggatcttgccggcggtggctatggctggtgccacgaaactgccgaaattgtcggccagtggtttgagcgctttggccgttgcgtcgatggcggggttgagtttgttgaggacgtctcgcatcgcgttaaggacaggcgtttggaactcttccccaaggcgtcccatagccgcgtgcatgttcgccatcgcgccctggaatgtagtgcctgcggcctgcgccgcgcctccaagtccttcctgtatggcgtccgcgaaggtttggaagtcgattttgccggatgagaccatgtcggagacttcggcgctggtcttgcccaggtgcttgcccaagagttggaggacggggatgccgctgctcatcagctgcagcatgtcgtcgccttggagtttgcctcgtgcggcgacggatccgaagatggtgccgatgtcggtgaggctgcgtccagagacctgagcggtgtcggccacggttttaagcacattggtcatctggctgccggatttgatgccggaggcgctcaggcttgcggccaccgtggcggcgtcgccaagtccgaatgctgtgcctttgacggcggtgagcgcatcgttcatgatgccgctcacatcaccggctgagtggccgaggcctttgagtttggcctgtgcgttctcgatggcgagggcgcgttcgaagccgccttttgctgcgaggccggcgatgccgccggtgatggtgcctatgacgccgagtccggttttgccgatcttgccgaaagccccgcccaccttgctgatgaggctggtggagccgtgctggctcgccttgtcgatgctgtcgcccaggtcgccttcgatttgccggccgaagcccctgccggagggttcgacctggacgtatacggttcccacatcctgtgccatcggtagtgtcctcgtaattctgttgggcccgatggcggtcgggttagttggatatgtggaaggtgtcctggaggtgttttcgccgttccagccgttcccggcgttgcctggtgccctccatatggtccaggcggaagggatcagcgcgctggtcggtccagggccggtagcctttgcgtttgagccgcccttcgagttccatctggtcccagagggcgatctcggctccggtgggtatgtatgaccatccggagagcgccgcgtaactggagctggtgtggtcgcgaaggatctcgcgcgacagcatccaggcacggccgaaaccgatgttcggcctgggtttaggctcgggtgacgcaagccagtcagacagggtcgccggtcgccatatcagccggtagcggcgcagccaatcggcgtctaacgctcctcggtactgcgcgtggaggacgaggaggtaagcgcttttgggtcgattccgctttcggcggcccaggctttgacgatgccggtcagccaccccatggcattgtcggatctgcgcagccggttccataaggtggggtgtatttgctcgaagtaggcgaggaagaccgccattgcctggtattgctcctcatcggaaaggacgactttgcttttgaggatgaaaatcatctggatgatttccagcggcagttcagccttgctgttcagattgggcaggtcgaacttcagcccgagcgcttccaggtgcacgtcggggtattcggtatcgtcctcttcgatgtcgggttcgacgatcgcgtattcgggtttatcgctcatggcggtctccttgtgtcttttggtatgtgatgtggcggccggtgggcggaagaggggtcccgcaccgtgggaccgccatcctgcggtgcgggaagattcaatgaggcctgtcaggccaggccttcggatgcgccggtctccggggcgtcctgatccgtttcaaatcgttcggtgtccggaccagggtcggctgcgggcccgctggtgttcccatcctggttcgcggcgaggtttttaggccgcgcggccgatggcaggatgccgaaggcgtggaactggtagccgtccttgcctttgagcatggagagggtgatgttgtacaccacgttgtctgtgtcgctgaacggcaggtcgtcgcggtcggtgactttcgcgcgctgcccgtagacgacgatcgggttctcgtgctggtcgagcgcgaccagcacccagctgaactcctccggggtgctcgcgtccttcacgtgcagcgcgccgttttcatcggccttggtgccgaaatacgcctccacgatgtccttcgtggattcgatgccggggatctgcagcgtccagttgcccggcgcggtgtcggtgatgaccacgtcgccgttatgcgccttgatctcggtcgtgtcccccggttcgggatgcaggacggcaccgtcctcggcgttgtaccccaccggccgcttgccggccggcggcgtccagtcgaccgatgctgggggagtgaagctctcgtctttacggaacaggtagagcgcgtaatccttgatgagtttgaccagatcggcgttgttgccgctggatacgaagtcttttacagccataagccatgtgcctttctatgatttttttttggctgaaagggcatgtggcggcatgctcgttgattggtcagctgacagcggcctgcatgagcaggaccgcataacagtagattggggatgcatcaccgtccgcaagacgcatggggccggcatccagtttcgcgctgacgatgggcggcctgcagccctgcatggtgatggtgcggatgatgtcggcggccagatgctgctcggcggcgaaatcgccgctgccatcgtcgcggcggacgatgacggtgagcctcaccctcacccattgcgtcaccggtgtagccaagccttgggggtcgccgaccagcacgcactcacgaggaggatcgtcactgttgcgcaccgacccgaaactgacatcagggtattcgcccctcagcagtggcagcagcgtctcttcagtcctgaccggatgcacaggaggattgaatacgctcatatccgaatccttcccaatgtctgggtgagagcgccattgacggactcgttcttcgcatcagtgatgaccgtcacgccgtttcgcgtcctgccttgggtctggtcgcgcaccttgatgcggccgcgcggattggaacctacggctttcacgcaagcgtcatgagtgacctgctgtatccctcgggatttcaatacttggtcgctgaaggccttgcggttgaacacgaatttcgctttccccatcggtcactccctgcgtttgacggtgatgacatcgccgacatgccgcccctgccggtctacccatacggccgggtcgccgtcaaccggcaggcgttcgccgcgcaccccgatgaggtccgtggcggtgacgcccgtcggctgctgcgagcgcacgtacagcgtgtaggcgtgggcgacgcccggtgatgtttcggttggcgtttcgggtgtcgtgatgggtgccacgagcgcctgtaggctgccgattttgaccagtggctcttggatggtgttgccgtccgcgtctttggcgggtttcccgcgccagatgtcaatggtttccatcggtagcctcgcacatgtcaatcgaaaacgcctgctgtttggcgacgcccaggtccctgagttcctctttggtgaggtagaggttgccatcaggattgctccatgagtagctgttggcgaacggtccaaccgtttccgaggtctgcgagacaccgccgggcacgccggccgagtcctgttgcatggcgcgtttgaccatcgcgcagcaaattcgtctgagcgtgcgcatgtgggtttcgatccacatggtgtcgttggtttcgggcacgcgctgccggattttgtcgcttgcgtcgtccaggagttccatggctgaccgggtttccgcgtccgtcagctcatgccatcgcttggccaggtcgtcggtcgtggcgaacggtttcggctcgtcggtgtcgtcgtccatgtcacgcccgcttgacggtgatggggatggtgctgccgtccgagagggtgccggtgcctccggtgatcgttccgtccttgtcggcggtgagctcgatggcggtcagggataatccgtcgtcgcccttagggccagccggccccatgtcgccttggggtcctacggggccgggctgcggttccaggccttgcgttcctggcgcggtgccggggatgaacggagtgccgtcagggttccacaatgctaccggcgcgtcgagcgggccggccttgtgttttttcttcccgcccgcctgcacgatgaggttctgtaccggataggccatgtcacgccgccttcttcaatacggcgatgccctgcgggtcgagcactgtgtaggagtagaccgcctgcgtacggtaggcgatctgaccgtagtgcttgaggtcctgtccgacgccgtcggggtcgccgtactcgatgatctccgaggtgatgttgcgcaccatgccccacttgatcaggctgaaatcgccaaggaaggcaagcacgttcgtgtcggtcgtgcagagccgtccgttgaccgtgccgcttgtggaggcggggatgccgtcaaggccgccgacctgcaggttgatggggatttcggggtagaggcgcatgccggtggcgggcaccctcagcttgcgcaggcttgcggcccacgtcttggacagagcgatgccgttgatgtcgtactcatcgctcacggcttcggcgagcgcgtccaggctggacacgtcgtcatccttcgcattgacctgtatggcggtgtcgcgcagcttgctgtaaccttcgagttcggtcttggacttggggtcgagcccgtggaagaccacgtagtcgagcgcgcggcccatcgctgcggcctggtcggattggatgctgtcgatgatctggagtttggcgtcgtcgtcggcccatttgagctcctcgttgatgcgggtggtggtcacgaccttgaaccgtttgcccacgatcggggtgagggtctgctcgtagctgcctttcttctggccttcggccacgacctcggcttcggactgtccggagaacaccatgaacttgtcgtccaggaacagttgcggggtgctggggctgagggcggcgatggtgctggtgtccttggccttcttggtgattgcgagggctacgttgctcggcagcgtgaccttggtgctttccaatgccattggtattcctttcgttcgttgttatttggtgccgaacatctggttgatgtagttgagcttttcggcccgttccgggtcggcaccgtggtttggtgtgccgttttggttgtgtacggctgcgccttttggtttcggatggaggtaaccgtcgagccgcttggcgaaatcctgcatctcttcaaggcttccgcccctgatgaggtctgcgggcacattggtttccttggcgacttgagcgcgccactgggcctgtcgcttctcggcctcgtaggcggtgaccttgccttcgagctccttgatatgggcttcggctttctgcgcgtcggtcatctggctggccttgagctgttccagctcgtccgcggcggccttgttgtccttggcgcgcttctcccagtcacgggagtgtttcatggcctcgttgtacttggcctcccaatcggtcggttcgccgctttcgacagggtccttttcggattcggttggggcggagccgccagcgctgccggagtcgatggtgcggatgtgcttgcagagcgggaagccatgcatggttgtctcctttgttgttggttggggcccgtttcgggcataaaaaaaccacccgtgcgggtggttgggaaaatctatcagtcggcgctagatggcggcggtttgtcgttgaggaagcagatgcaggtacaattccttgtcctcgtcatcaagcaggttgaaggcggagaaaagcgtatcgtcgggaatcttccgcgcgtcttgggcggtgatgctggaaaagaaccaggcaagggcctcgtagggctctcccgcgaggaccgcgccgtcgcaggatatcctgtcttgctgatcgagcagggggaatacatagggcttcatttcggcaaccgattgtgcgattagttggtcatccgccatatcttcctccattcatgctcggtcatcggataagcggtgtgcaacgcgaatcgtccgtgcgtgtttcgcctcttctgcaaccatactctaatatgctggccgtccataagtttggagagatattcacggttgccgtctttcgcggcgctgacatagtctgggtttgcaatggattccattaccgcccatttgactcggctctcactccaatcgtcagggaaatgcgttttgtggggtaccctagtgccaggtccatgtccgtcgaacacgtgatcccaaccatgtccttgtgggcggattacttccatgggccagggggcggaaagcggccaggtgccatccttgacctgatccggatacattcggcgcatctgccggagcgcttgccggtagtcggcggatgaagcggcgcttttggctgtctggtacatctcggcgaagcgtttggggtcgtatcctttaaggatctgacggccccagctgggcacgatgtcgcagtcgcatttgtcgtgatactgcatctgcctgccggccgaatcctcggagaggtaggcgaagccacgggaggcgagcatcacgcagaacgcgcaggtcttcgacccgcgcggcactctcgcccaacgcggcttggtcgggtcgatgcggacgttgcgctgcgtggtaagccgggcggaggcggcgatcatgtcggcgacgaactgctgtgcgtcgtccacggtggacatcgagggccacaggtcgtcgatgctcgcgccggcccgcgaacggccctccttgacctgggtgtagttcaggccattgtaatcggtgtcggaaaacccgccctgcacctgccacagggcacggtcggggtcgatgagttccgcatggtcgaacccggggaagtcgacgccggcgtactccgaccacaatcggcgttgcacatcatagtagtcgttcgcgagctgtgaggcgtcgcgagcgtattcccgtacaaattccttgacgttcatcggatcggtgcgaagcatctcctcgatgctgtccgtggccgaatcggtcaggttctcgatatcgtcgatgtagttttcatgcgctctgtccagcaggcgttgcagctcctgtttccggtccggaggcaggctcagatcgttcaggtccattctggccctccttgccgccgaatcttatgcgggcgatgttgtccttcgtccgcttgtcctgctggctgtcgcgcagctgccggatctcatcgtgggaaaggcccagccgggcgagtcccacgtcgctgtcggcgtacccatcgacgagtggtgcgatcttgctgaagctgtcggcgcgcgcgccgtcggacacctcgcgtgtgggtgcccacaccgggtgcactttgtgcaggtcgtcgggaggtgtgcgcagtccctcgcgcaggcacacggccattgacatcgcttttttcagctgcctgccgaacgccttgttctgccggtcggccacgcgtgtcagccgtcgttcggcgctggccatcgcctcggccgaactggggttgtcgagcgtgatgccgagatagtccaccggcaggcgggtctctgcggcgacgagcatggccacggtcttgagcatgtcggaatgcggttgcatcgatgcctgctgcacctgctgtatctcaggcctgttaccgtcctcgtcgtagccgatcgcgttgatcgcgctgataaggctcttccacgtgttctcggaaaaggcgtccttgttcgcgcccaggaaccagagtttcggcacggagtagaactcggcgctggcttccatgcgcacgatggtgcggaacccgatgtcggtcagggccatgaggcttcggctgatgcgggagcgcccgaaggggcggtccatctgccggtcgtacgccagggcgaccacggtcggctgttggaagtgcgtctcgtaccgctccgcccgccagggcaggacgtcgccatggcattcgtacaccttgccgggcagccacacgttgaaaccgttgatacgtccctgcctgtcgtcgctggtgatggtcagcgcggcggacaggcggttgttggcccggtcccagatgcccgacgaccaatcggccgaacgcggggtgaacaggatgcgatcggtgtcctcggggtcgacggcgatggtgatgaagctgcacgagtgcttgtaggcgctgacgatcgcctcgccggcggtcacgtcgagctcgttgtcctcgagcatgtcctcgatgccgtgatcatcacgcccgttcgggacgctgaaaccttggaagtcgctcaggtcggacagcgagcgcacggccagttcgggccaaccgatcatagcctgcgctctgttcttgatctggtcggggatgctgatgccgaagtcgctgaaccgttccttggcgtcgtagtaggcgctgcggatgaggttgcgcggatacttgctgcgccataccctcagcagttcgcggacggtggccatgtcctcgtcgtcgaccccaaggatgtcgggtatgtcggaggattcgacggccaggtagcggctgccggtgattttcggcgcgatgttggccctggtgccgttggcaaggtagaaatccatgtcagaccatcactttctgcactcgtccgggacgtcgtttggtgatgaaggtgccgtagagcgccagcgtgcaggcgaccaaagggctgatgtcgatgtcgctgccgagcttgttccagccgaccgcgcccgagctgccgatgttgcgggtggtggcgttactgacagcgaggtcgagggcgggttgtttaccgtcgtccaggtgagtgagcttgccgtcgcgcagcatgtctagcatgcgtccgcaggcgcgtcccatgtcggtggcggtggtggtaatgaccttgacgtggcgggctttcaagtcgggcaggagggccatggcaggggattgggcatcgatgacgagggcggcagtgcgactccagcggtcagcgatccagtccacagcccaggcggtgcctttcgactgggtggactcgaaagccttcaattcgatgtgagcagtgccgtcgctgtgtttgacgcagccgccgatggccaggcttgagcggtctggtggcatgtctatggcgtagccgaccagtccggtggtgtccggtgtgctggtggcggcctgccgccattgcgtggggtcgatggcgctgctgatggtcgcggtgtcccagatgcccaggccctcgcgacggaagctgtcggggctgagctgtttctgcaggcgcaggatggagctggccggcgtgcgcctggggtaggacgggttcgctttggaccattggtcgcggtcatcggggtcggcgtcggggtcggcgctgaattcgaggtagagcatgtcgtcgccgtcgttgagcgcttcctgccggcgcgcggtgaacgcctcggacgggtcgccgggcttgggcggggtgcccatcatgatcagcaggccattgtcggcggtgttcatggcgggcaccatgtcactcatggcggtctcggtcagaatctgcgcctcgtcgaagataaccacgcccacgcccttgaaaccgcggccgaagccgcgttcgcgtgcgccgaatagtatgcgtgacccgttgctgaaggcgacctcctgctggccgttggcgctgcggatgcgggagatgtgccggcgtacccctttgcgctgggccatggcgcgcatgtcgccgaacgtctcgtctgaggtgcgtgagcgatgggcggtccataggaccatgagccccgggtgcaggatgcacagcatgaagacgatggagccgattaggaaagtcttgcccacctgtcggcacaggctcatgaccacgccgccgacgccggccgcgtacttgccatctgctcgcttagccagaatgagcatgcccaatccgtcctgccaacggtcgaactcgatgcttagcagcgcctgagccaggtccctgaccctgggccattccgaggagacgatgccggaggggatgagcaggtggcgggcggactcagatagcttcggcgctgaacgggacatcttgcgcctcgctttcctcgttgatcagggggaaggccgggccgtcgtcctcctggtaatcctccagctccttggaagccgagagcagctgcctggagagggccggaaggtccctgctggaggtcttgtccgattcgatggctttcttcagccggcgcacggtcaggcgcagcatgtcctcgtaagtgggcagcgggtcaaccatttcctcgaagtcttcctgagacaagtgctcagggtttttacgtctgcgtggggtggccttggcttgcttggtcgtcctacttgatgctggtgttgaccgggtgcggtttcgactggcttgcttgcggcaggctggtgagcaatacttctgatccttccgggaggggatgaatgctttggagcactgcgggcatttgcggatctctgcggatagggactcgtgcgacgtttttccgctgctcacagtcctcgcctcctcgtaagtcggcagtagtggtccttcattgcgacgttttggattctgcgacgcttcttatcttcttgggtattgcccggggagggaacagcactgcacccgaggaggcctcacccgacccccggggggtccatcccccagggttcaccagtcgccgctggtctccaaaggcagggaggtggctcgaatgtcctcggaacggcctgttcgttgaagctgtctgatacgctcacgtgcccagtcgacggtgtggttggatctgatgcgattgcaccaacggtgggcaaggcaacagttggagaagtcggtggccgagccgccacggctgaccggcaccagctcatccacctcgggactgccgggcaatcccgccggcagacttttgtcgaccggacggccgcacaggtggcaggtgtcataggccgccttgacccttgccgtaacctggtcacgtcgccacccattggttctgcggttattgcgcctgaccattgtctggtgtctggctgatggctacccatgcaccttgtgggtaggcggcgatggttctgaagtgccggccccataccgtcagggtgccggtctttttgtcgacccggtagcccttggcttgcggcagtggggtgggttcttggtctggtgaggtgctgaggcggtacattttgtttcctttccttgtggtttaccatgctattctttaataactgtgctactatagtaattctcgacaaggaaaggaggttggacatggatgatatctggcaggcagtcaccgcgctggggaccttcctcggcgggcttgcggcgctgatatccgccatcaaatccgatggcaagcgctgcagacgcagaaagtgacggcaaaggggttccggttagccttacgaaccggaaccccggcctaccagtctaatccatggagaccatcatgaggaagataagcacatacggatactcaagcccggcgttctctctggcagcagcggcatcggccgggttcgggtggcccgtctggcttatggccggcttggccgtggtcggcgggtgcctgggtctgatggctgggcgtgacgatgagtgaacggttcttgtccctgacggaaatagccggacggcttggaataacgacgggggccctggcgaattacaggctccccgaacccgacgtaatcgtgggacgcacacgtggatggaaagcggagaccatcgatgaatggaaccgcaaccgtcccggtcgcggggtcggaggaggacgaccgagaaagaagtgaggtcatccggctcgcgtcagtgttgtcggtgtggcgtgtggcgtggccgggtcggcacggcgtgaaggctcgaactcccgtccatggtttggagaccgtcgggctacctgttgtgcaacgccgcatgatgcccgcagtagaatcacgaagactgcaggcaaggattattcggattgacaggtctatatatggtttcgcgagactgtctctgttcaggcagaaactcaatctcagttcaaggtcgggtgctggggttagggaaaggcagcaataagaaggtatcagcatcttttgccatcttgtacatctttagcgcagttcgccttgcacgtctttggtgaaagtttgaatggccttttccaaattaatggttatctgagggttcaagtccatttcttcttcatcacctcctacgaacaagcgaggcaatttcgtattagagggatccaaagtgtaatcaagcatgaagttggatgccttaactaaactgtttgcgcctttttcgagaggcggataattcgctataagtgcgaatttgatacctctaatttcgtccagtactttctgctgagaatcacgataacgatccattttggaaccgtcatcaggtgtgaagtattccagcgcactggaaccatcggatgatagacttaaatcaagtctccaagacagctctgcaagtcgttcgcttagccgttcaagaattaaacagttgctcaataacttgtcggcaagagagtttagtttttcgtttgattggtcttttttattgcgatgaatctcaaaccattttggcagaaacggtgcaaaaatacccgatatcaatccaaagaaagcaccaataagagttgtaatagcgctcgagctaatcgtcatattctgattctacaatggcgaagacccctgaaagtgctctttcatgggccttcgtcaagcattatcttcagttttgtgaaaatcaccctggcttcgccacaaatgaccaacactactagtattggcggtgacagcactcttgtcaattttcggtgacagtccgtctggtcaaggcctgccatacgtcccatagcagatacacgggcttgccattctgcacgcccacctggcggatgataccccgcttgcgccactggctgaccgtgtttctcttgatgtctaccccacagcctttcaataggtcgcacaatcctgctgcggttccttgggtcccacatgaggccaggcgcagtatcctgatctgctgcacctccttgactttcagggtcctgccgcaggaggggcacacggtccatccgcccgcgatgtcctcttcgccgcaccacagctcggccccgcaccggtcgcaatagccgatcagcgtgcggtcctcgggcggcgtgaactggcggtccatacgtgtcacaagcacggcggccacgcgcttgatgatggtggcgtcggggcgggcccgcagttggtcctgacgctcgatggccgcggccagtagcccctccgccggcacatgccgctggcgcacccccaccgcacgccccaggctcctggcgtagcgctcgatgtcctccatgaggttccacgcgcccaagttcagcgggaccggggccacggtgcgctgccctccccgagactgcctggccatcacggacgccttgcgcgcggcgatctgccgcaggtcaggcaaccgctcgcgtagcaggcgcaggtcacggccgaaccgctccccgtcggggtcctggctgacggtctggctcatgcatgctccttttgtgtcgtcttcacctcgtcgatgacggcctgcacttcagccaccggatgcccgatcagcttggccgtctgccgggccgtgtggcccttctcgtatgggttgctggtgtctcgtccggtcagcgcgtccaggtgtcccttgtcgtagccttgctgccatgcttgggcttgcaggcgggacgtgcgccctcccgcgctggcggcatccacgtcctggggcgtgtggtccaggagccaccgtccaagcctgcgggcgacgctgatgggcatggtcgtgtagtcgccgtcgaagtcgcgctcaaagcccagtcgcagctcatccccgtcaatggcggccagcaggtcgggctggctcgcgagtggggaccaggcctcatgactgacgcgagcgtaatcggaccggccatctcgcccactggaccaaatagcgccagtcccgcgctcgataccgtacgtcgcgctcatgcttgcctcctcgcttcactcatggttgtttccctccgtgtcattcggtgtttgcgcaggcgtccagccaccttcgtcatccagcagcacccacccgcgcccactaatgtgcaagggttggtcgcgcgggtattgccaggagtggaccagcagccccctttcatacgcttgggcggggttggcgtgcacccacccgtggcatcccgtcgtacccgacccgcacaagagaatcaggttggacgccaggtgcagaccggcccacgcatgcgagcgcggtcggcggtggtggcgtgaccctgggacgctttccaggcttgcgccgcagcgcgcgcaccgccacccgtccctgcggtccaccattcgcttgacctggtcgctgggttggctcatactggttctcctgcctggttgatgattggtcggttggcgagtctggtgtgtaggctcaggtccaggtattcggcgttgatgtcgatgccgacgtagggatgtcccaaggcttgcgccgcctggccggtggtgcccgatccgctgaatgggtccagtactgttcccccctgcttgcatcccgctttgatgcatcgcatgggtagttccagggggaaggtggcgtagtgcgcgccgtggaagggtgtgttgggtatgtcccacacgtccccggggttgctgacgccggtgcatgaggattccgtccgctgttggcggtgttgtcggtactcttgccccgggcggtcagcctccttggtggtgcgtccccatgtcaaagcgctcccgctttgtttggtggccggcgccttgatggcgttgaggtcgaaatagtacttgtctgatttgcttagtaggaataagctctcatgtttaacggtcagacggtccttggtgctggatggcatggcattgcgcttgtgccagatgatttcgttgcgcagaatccagccgtcatccatcagggcatacgccacgcgccatgggattcctagcagacttttgggacgagcctcgtggcatgttttggtaagagtgccgactctgcatccacggtccgtggcctgcttgccgctagcgggtgaaggtctgccgccgcccgcacgctccttgcccgaaccggaataacaatccgcaagattaagccacacggttccatcagcggccagcacacgcgataactcatgaaatacggattgcacacgctccacatactgtgcgaccgtgggctccagtcccagctggccggcgacaccataatcacgcagaccgaaatacggtggcgacgtgactacgcaatccacgcaaccatccggcatatccgacaacaccgcgacagcatcacccaggtacaggcacaaagaatcgtccgcaaaatacgccggccgtccacaacacaccccactcatggccgctcccgccaaatcgtgattacgtgatccccgtcctcgaaccgcgccaggcaataacgccggggagctgacagccaccaagtgccagcgagcgcggcgagcatgagcgcagccaatgtcaaggcctcggccatgcggccccacgcgccttcctggaaatacctgccggcggtgaacatgtcgcacaaagcgaacaacaggtcccacaccgtccagaaccaacggctgcaaccacctacccgtctcatcgcctgcctccatcccacggatcagctggcatcgcaggattgaaagcagccagcatcatccggtactcggccagatcccgatccaggcaatgcttggtgcggtggtccgtcttgggcgagcgtgagctgatgtcgtcgaggagagcggggttgatggttcgcagggcgaggcgcaggctggtgatgtcgagccattgatggctgaggagcccggggatcagctgatgctgggtggtgaggaagtccaggtcgaagtggacgctgctgccggccggatgcagtacgaaatccttgctgtacgtgccaaggaatccatagatgcttcccatggttccggcgcggctcatgccctcggtcctgacggcatcgagcaggccattgcgggagtggtgctccaaggcccacgggtcaatggtgctggctttgcctccctccgggtccacgatccaatggtcggagtcgagggtctcgctggatccccgaagatccgtgattcgcatctcgacctccagaatgggattggtcagagggtccaggcctccggtctcgatatcgatccacagcagccggtcggggcgtgcgctttgctcatgttcgctcatgcaatctcctccaattcgtcggtgggcatgttcagggcgtgcaaggcctgggcggcggtcttcccttggttgagcaggtcggccaatgcgcttgccgcgcggatccagggcgagctgccgaagccgccctggtttttgcggctcaggtggtagggctccaggagggcctgcacgtgctcacagcctggagcgtgccggtggggtgcccgaacgtgccgctccggcatgggcgtgggcttgtcgtccacggcgctcggatggcgggactgctcctgggcgacccacagccggtagcgcttgtgccagtccttgagccgtccgcccttcgcctcggcccacagacggaagtccctggcggtacgatccgcatccacaccacactgtcgagcaaacaggcggtcggctgaatccggagaccagtcagcagggaatggcacgcgcttggatttaggtttcgatttcgccggtgctgcccccttgggggctacaggggtgtttaataatggttcttctaatgggttgggtgaaggctggttcaccccgtggcgacgtgattcttcaccccgtggaatttgacgggatgaaccagccttcaccccgtcggtttcacgggctgcacgctcgttcaccccgtcctggccgagctcctcatcgatggcccgctcacgctccacgctcatgccggactcgcccgccggcgtcatgcatagatcccacaccgtggtgcgccggtccgcgcggatatgcgacagaatgcgctggtccccggcgcggatgaccccagcctccttcaaccgggacagatgctggcgcacgcacctgggcgagacgcgcgcgatcctgcttaccgtctccacactgggataagcgccagaaccgtcgggccgggcgaaatcggccaggatcaccaagatcagcctgcctgtgctgtccgcacccactggagcgtcacgcaacgcccaactcatggcctgcacactcatgaccactcctttccaagcccgcgagcgcgggtggttgtatctcttattggccgtgtctgttgctgatccagctgatggccgcggccgcgataatcagcaggatggtcgctatcgtctgtctcatgtctgcggcgtgtatgggttcggcggcaggatggatcgttggccggcctggcggccttcctcccatgcctgctctcggacctgccgtagccaggtgtcgaaggcgtgccaggcgctcatgctgcgtggggcgtcgaactggtcatggacagccgtgcgtatcgcatgacgggttagtggcctggcgagcgcgtcagaactcgggctggtcatcgtcacccccgaactcctggccaggctgggcggtatggccttggaagccggacgcgccctgagtacgggtgacctgggccgtggcccggaccaggctgggtcctatatcgtccacggtcagctcggtcaccgtgcgggtggagccgtccttggcctggtagtcgcgttgggagagcctgccgaccgcgagcgcggcggagcctttacgcaggctctgtgagatgtgctcggccaggtcgccccaggcggtgcagcgttggaagagcgttggcccgtcctcccactctttggattgccggttgaaggtcctgggcgtggaggcgatcgtgaagttcgccacccgcttgcctgaccctgtgcttcgcagttccgggtcggcggtcaggttgcctcgtatcgtcagtgtcgtctcgttactcatttcctgggtcctcctcgtggtcttgccgtatcaggtccagtcgccgccacatctccgggtcgctgtggtataaggcgcgacggaatgaggggtagcggcagaaatagatgtacagacggtcaaatttgctcacgccagctccttcgcagcgccgtggacaagcctgtgcctcctcgggaccggcggcgggcgcgagccacgtaagcggccttggccctcgcctcgcgagccatgcaccttgactcgacggctatgcgggctgagcgttcgttcacccattcccgaccaatagcggtgatggtctccgccacctcatcaaggaaagcgtcgacctgatccatgtcgtacccctcgcataggcgatgggtggtgaactccttgtcatgcacgtccttcggcgtcaacatcacgcgcctccttcgcctcatccaggcctacggcggtaagccgatacctggaacaccgtccaccggcctcgctgcgaccttcctggtccgccgcttccgcacttgtcaccggatcaccggattgggggagcgccatcacgtcatcgatcgtcaacggttccacgcgcatgcttcccacctccccaagccgtacctagcggccaccaggccgaacgcggccgcggccagatgcgtcagcgacagcacgccccggcaagcggccgcaacaacccaggccgaaccccagacggacatgaccacgccgaccgcacccagcagcaggcacaccacgccacgaacgttcatcgttgaccccccttcggcacgtcacccatgtactggcggatcgactgcacgctcaccagcttcgtgcgtttgccgcgctccttacgggcccgcagccgaccggccttgatcaggtccctggtgaaaccgtcatcctgcatccccagcatcctggtggccgtcctgaccggcaccgcgatctggtaggtgtccttggacagctcgaccgccacctcgcggaaagcggccaccaggtcggccagacctatctgcaccaccacggtgtcgccgttccccggcaagacgttatcgcttgtctcactgcgctctgttgcttgcgttggtatactgtgatcagacatgtaggtgctccaacctttcttgtctacaagccgctgcttcaccagcggcttcttccttttctgagtgatgccggggcgggggatagggaagcccgccgccccggccggtcccctaagatggattgcaaagccgcatgtagggtgcggctcccaccgaaggggaagaactatatggggacctttgcgaattggctgctggacaactgggcagtgatttgcgggtggctgctaacaattgcgcttaccgtggcgggatgggccataacggccgccaggacacggcgacagaacgagcgcgaggccgccgcgtcccgggaacggctggatgcgtcaaacgctcgaatcaaggttctggaagggcaactcgaggcgcagcaacaatccgcgctggctcttagcgagcaagtggaccagctcaaagaagcgaatcggcttttcgaagcggccaacccggcggatgccgacccctggagttccgcggtcaacgttcgcggaatgcagtaccgtgtcaccaacgagggggcgagggatgtagtggtcgatacggttgggccagacgatgaccgactcccattcaggtgcgagcgcgatgtgccttttgagtgcggcgctggcgatggattcgactgcttcgtccccggcacgaactcagggacggcatccattacaatcggctggcatttcgtcggaagcgcggacataagggccacccgccgtccagtgtgaaacgtggaggtattcatagcaggcctcccatgaaacgccgagcatcgtccgcgccgacgaatctgaatttctcgtacttgatcaggcatttgtcgcccccgcagaactcaatggttatggggtcgtcagtcaatccggaagtcgacgagaccggcgtctcatgtaataggtcggtgatttctgcggcgttttccttgtcggggattaccttcacgtaagtcatcgctcctcctctcctgcgagcggcaatgctgccctcagatgtctaaatgagacaatgaaggcacctacgcaaagaagggaggtgaaggtatgcagcgagatcccattgattcggcgaaggatgccagggaagcagcgcaggcggggaacactcagctggcgttggctgctctggccgatgccgtgcagggcatagccgagtaccagcggtacatacgcagtgatcagatgaagatcaagaaggcgctgaacattccctgattcatgtttcctgtcgtccgtcgcagcgagcttcatctcccggtggacgacgttctgcacagcgcccagcaggccgggattgcgcctctcgaactcctctgccgacatgggggcatccccagctcggctgtttcccggctcatcccatatggaatcccgtataccttcgaacggaacggatgatgttcctgtgaacggacctgccgtcgcacccacatgattctgcgtcatttctcctcctctcctgcgagcgcacaggaattggctttatttgtgtggtggtcggcgttgtataggatcgtttgtggttggatcgagggtgagggttttgctttatgggtgtggtatgggattgggttgtcggtaacgcggtcactgtcggcggctgggttgtgaccctgacggtggcgattatcggttgggtgattagtggtgtgcgcattcgccgacaggatgatgcgagcataaaagccaagcagggtgagctcgatgtcaccgtgaagtaagcgcttggacatggttcatctccttccatttgacgattccctcgtaagcggagaaaagcgcgatgctgattcccgctaatccaatcgacaagcaagacgtgattaccaaagctctcggtagcttcatttctcctcttctcccgcgagcgccgaggattgagaggagtgctcgtcgcaatagctaagtgccgcgcttggttcgactccgacttccctggacagctgtatgaatttactgagcatcatgtcgccagcttcaaatcgggcatttagggtgggtctggatatatgaagtgccgaagctagttcagttttgggctgctcgttcatcagggcctttttccgcaaaccgtcaatggcttgggcagccagtttgtaagagctttctttcatgtctgtaactgtaagagctttctatcattatgtcaaacctgcatgctggtttgttaaaaagcttttacgtgcgtaatctgttggatatggcaaagtatgcgagtgtgtggacgactacagatgtcggagtgatgaatcttatctcgaagaagagggatgagtctccattccagatatcggatagagcgcttgctcgtgccatagatgtgagtgccccaaggattggcgatctttttggccaccgacacggatcgccgtcgttgcgcgagttcatagccttgtgccaagtttttaatctcagccccgcgagcaccctggaaaaggcgatgcggctgagtgaacgtgcggatgaacttgaagaacgaaaagccaggctggatcgagtggcagcgcaccctgaggattacgatattgccgcgaactacgatccgaacaaggagctggaaagggagaccccacgagattgagcaagattgtaggggagggaaatgatgcggccaagctatgacgacctgctgctcgaagcgatgacgctgggggcgacggtggaggagcgcactttgcaacatggcctgtgcggcttctactgggaccgcgagcgcaccatagtcatagatgacggcatggcggactggcagaaacgctgcgtcctgtgccatgagctctctcacgcccggtaccacgacgccggctgtggcacgaactgcagcaaagccgagcgacgtgcacgcaaggagacggccctgcgcctgataagcccattggaatatgcaagcgccgaagctgcatatgacggcgacgctttcctgatagcatcggacttgggcgtaaccgtccaggtccttaatgattacaggatgtggctcgacaacaacgtcagggcctgacagaagggaagaacgaatgacggctggaatacgtgcccgcggcattgtggctgtggttggagcgttgacgatgattttgggcctatctggctgcggtgctcagaagacggtgccggacgtgacggggaagaatttcaccgaggccacctccgccctcgctaaggaagggttcgcctacgaagctcaggatggaagcgggcagcccgcggttgatggaaccgtcaccgaacaggatcccaagggcggcacgaagactgacgccacgaaagtaaaactcacggtgaggagttccgctgacgcggcgcaggagcgggccgcgcagaagcggaaagagaaggctgagaaaaaggcgcagcagcaaaactcgccagcacctgccgagaagtccacttctggcgggctcacccagacatatgcgcagtcagcctgcgatcaacgcggccaacaggaattcccctacggatacaaacctcactacatgaccgctggcgcggaaccgatgtggtcgcccgatagcgtcatgctccagtacaaagcgaccgttaagaacgggtacaacgccaagcgggatgtgacagtaacttgtaacgtacgcggttccaatgatcacccggaagtattcggttggttggctcagtagaggatttactctcagtcgtggctcccgtggagtgcgcgagcgtggagcttgcctatgagggcgatgcgttcctcatggcttcggaccttggcgtaaccgtctaggtcctgagtgattgcaagatgtggctcgacaacaacgtcagggcctgattgcaggaggcgaagaacgtgagtgctattcggttttgctgctgtatggtgtcagatcgatggggtcgtgtggccgaggcatctctagtctgagttccagcgtatcgttctttttccggatgtgtgcgagggctacggattgcccgtttggtatctgcaggtagtggcgtgccatttgataggcggtgatgtatccgatttcctcgccgtcgaggctgacgtagatggtggggtatcctttgtattttcctttggggatgtagcctttgcgaacggtgagccatatccatgcgccgtcaccgtatttgctgagcaggggcatatggtctttttcgccgcagacgctgatgctgccggctgcttcgagttcctggccggagggtttgatatttctgggtgtggtgttttcgctggcaagatagctggctcgcaggaatgatgtagttttttcgcggctacgccgtctggcccgatcgttttgttccttcatgatggggcgtggactggaagcgctttccattagagtgtagcagtggaaggtctgcttggcgtctgcgagcgctcgatgctcttcctcttcgtggatgcccagcagatcgaggagtgtttcaagggtgaggttggctgcgttcgggaacacatgcttgccgatggtcatggtgtccactatccgaggagcttccagtggtttgattccgagtgattcggcggtggagttgatcaggttgatgtcgaagctgatgttgtgccccatgattggtagatggcgtatcgcatcgagtagtgggggaagcacctgggaggccactggggcttgcgcaagcatctcgttggttattccggtgaggctgacgatggcagcactcaccatggtttgtgggcgtatcagttgggaataggttgctgtcaccttaccgttttggaccaacatgactccgatgtcgatgatttcctttcccttgtgcaagccggtggtctccgtgtcgatgaccgcgtagtcggcgttcttggccgcatgcgaaaaccctgtggctggataaacgaggttgggggagaaggtgggttccttgtgcgcaagggtgggggttgccggttgagatggctctggatgcgctggtgggtgtggggggattccctgttgttgctgattcggctcttgcctgcttgacgcgatccggctaggagtctgcccttgtgctttacccgcctgggtatgctttccgcggctcctgcgctttcggctgcgtcgaaaacggaggagaagatacattagcagaatcaggatagccgcgataatcagcgagaggatgctgccagacagattctccgggtgttgcgaaagccgcgaaatcccccagatgcccacatagccgaacagtgcgaccccgagccccagtatgatcaacagcagcgtgatgaacatcctcactccttcgtcgctccatgagccacttcactatggttcgtccctaaaagagatattatcggaagctgctcttatacctgagtgtcggataagacatggtgggtatgcgacgtcgcataaagtcccccgtccgcattgcgacgcggacgggggaagggtctgtttgaactattctggtccggcggcctggggcgaaagatgatcgcgatgcgcggcttcatgaaggccggggtgcagtaaattgcgacaaagacgttatttgctctgcccgtattttttgatggattccagcgcgtccgcttgggtgaatttagcccgttcctgttcggcggaccgggagtccatcagtagtgtgaaccttacccagaagatgcagcgtgcggtttcggaaagaatcagggcaacggaagccaccgccagagcctgaccgagcggcttgtcgacaaggatcgagagaagcggaagcagggctgccagcaatgagaagacaatcatcccaagccaattgtgggagaagttctccctatagttcttacgcgcaaccttcatgagctcgctgtcggatccgtacgcgagcattattgtgaatgtaatggaggacatgaggatgccggctaaagccgatatgcctgcgtagaaagccgtcagatccttttttgctggagggaaaaggaagtacacgagcgtaaatgatgcaagcatgggtatggtatcaagtgccggcgtgcgttgaacccacgctttcaccttgaaccatgggcctcgtgccattctggtcattctacgctttacctttctatcaacttgtatacctcatcctcattcttggagcagacatccacgagggtatcgacaagctgggaaaactgtcgtggctcgtcacattctggtatatcggccttcatgatcaacgggtggcggaggaggttgtaatcgattgcgacctcatcgattgtcgtgcctttcacgaaaagcgtctggcgctgttctgaaacaaccggagcgatttcggttacaacttccttgagctttcgtctggcatctttacttgaagtaggtggtattttaatcgttacatcaatgctgacgtcggtttgaagatcattcgctaaaggttgcgtcatgctcagcaattggccgccgttacgctccaagttgaatagatttcgttgcgtaacaaacttggcatggacctggtgcacgcctcccattttctccttgaattcacgtaagccgtcggctgtgtagacaggcacgactctccactcgaagttctccccattttggttcaatgtcgcgttcaggaactcctcgactagcttttctttgggtctgccagcgccagtaatgtacccgattgcatcgtgtttagggtagaatactatggctgacatctgagcgagatctgtctttcctgcctgtatgtcatcgtctgctaagtcaagcatctgatcgttttgattgtctattttttgcacgaactgagtgctgagtctctctcctatggtgagaatcgggtatttcttgccttcgagagccaacattaagattcgtttcgaggcgaaccagtgtttttctcctggtaattcctgataggcggacaacaactcgtgccaatcgagtgctgggacgctggggatgccattggtgattatgtttccgaatcgtctttggagttggaagaaatagactttgcgctctatcggattcttcttcgccatgcccagtcccttctcgtaacggtcaagaactattctgacacggcaggaagcggaagacggcacctaattggacatctaattggacaagaaatctgctgtactctggaaggtcctctaaccattgatttttgaaggatataattcaattccccgcagctccaccaatatcgaagcgccatcccgtgaggggtggcgctttttcgttgttgggaggggttggggctggggtggtggggttggccttgcatggcttcatttcgggggcctcaagcccaggcgtaagtggtaaatgtctcatagtgtagactatgcaaaggcgggggaatcgcattagaggggataaaaaaggggaacgaaccatggatgcaacaacagccgaaacgatgcccgaggctagccgcaagcaccgcaggctttggatcatcatcgcggccgtcgctgtcgtggcgctcatcatcgcgggcgcattcgcctaccggcacgtgacccactcacgcgccctggccgactgcgagaacgcccgcagccaataccaggccgctgtcaagcgactggacaagacgaggtccgcggccagccagcaggtcaaagccaccccggccggggacgtgtccgacgccaagatcatccaagccgtcaccaacgccacaggggacgaagccggcaagggcaaggccaagccggccaaggacagcaaaccggccatcccctcctgccccgccgacgccaacgccggaaccctgaacggcaacgcggcaaccacccgccaggccaccggcaaggcgggcaaggacgacaaggccatcgccaccgctgcggcggccatgaacgctgatgtgaggaagaccgtcaaggcccatttggacaaagccatcggcgacggcgaccagctcctgggctccaccgacgggcaagtcgccgacaacgccaccagggacgcattgaagaccgccctgaaccaagccaaggccgtgcaagccaacgccaaagccagcgtggacgaccaacgcaaggccatccaagccatcaatgaccaaaccaaagccgtcaacgactccaaaacagccaaagaccaagccgaccaagcaacagccgacgcggcgaacgccgcgcaagcgcaatccgcgccatcacccggacagggctactccggcggcggctacaccggaccgcaacactggaatggcggcggcgcataccgacccagcaacggcggcgggtaccggcccagcggcggcagttcacgccccaaccgggcgccagcaccggcagcaccggcgccagctccggtgacaccaccggcatcaggtggcggcgacagtttctggaatgatcttaacaatggagccaccggccctgcaattgatagcaatggtaactgcttcgctcgttgcttctgattgattcatatcgttcacacggacggccaataatcacaatcgcccgctggaatcatgtgattccagcgggcgaccgcgtgactgatagtcgagtccgcatgaacggaggaccaccatgaatggatcaccaatgtctggacaactggttggatgtcggtgcggtgactaacgaagcgaccgttaccgtggactcgtggacctttagcgtattattacggggcttggttgtcaacaacagcaggtcgtctcgtaatcggacttcgccgcttataacggtgtgtatatgaaacaacctctgttacgggctgaggtagaaagcccgcaacagaggtcgtcgttgtgtgttgtgattgagtcgaaagattcaacgtcatcagtacagcatcatgaagttcactcgtcaatgccggtgagtttagaggccatggcttcggcgacgatcgccagttggccttgggatgcggagagccactccttatgggacttttgttcggcccgggccattttcagcgcgtccttggcatcgtcgatggcctggccggcggcatgcttgagcgcttccttgcgttgggctttgaggtccttgagggcctccttggagcgtgtttgttcgagctcgatccgctcgtcgagggcgcgcacggcgtcggtggcggtcacgtcgtccacggtctccttgcgctccttgacgtgctccttggacgagtcgatggcgtcccgcaaccgttcgatccggtaacagcggaggaggatgccgacccagcaccggcggctcgcgccccaaccgggcgccggcgcgagcagctccgccggcttcgagccatcccggaggaatccgggatgacataaacaacggagctaccggtcccgcgattaacgacgatggcgagtgcggtgcgcattgccactgagcctcgctgtccagattcatgattgcctatcaaagtcgcctgtcaaaacccacacggcagcagacaggcgactttgatagccaacgcaggcgcgtaggccacccgggacaagacgatcgcccatgcgggcgttatgccacttcgattccccagcttcagccaacgagcgacccacctgctcgaccgcttaccccgtcgaaagcgggaccgacggtcaggtggtccgtcccgcctgtccgaggcttcaagcaaggggttacgccaggcgacggtcggggaccgctgttttaattgggggaacctacgggcccgcacccgccagcacaggagcggcgctggaacgcagtgccttttgaaacgaggagtaggaagacgggtccgtcatcctggccagcacctgcggaggcactaatccaagactattcatagtttaggttgcaccagctcttttttctaaccgaatcgggacttctttaactatttttaatcctccccaaaacctagtagtatcgacgaaaaactggaatcgggagtgccctccccgcgacaagttgcgttgcacgtcacgctaagctcaacaattgccacgggggcattcacagtcagaactagaaccccctgcggccatgcttaaaccaaccgggggccttcccctcacctggggccaccgccgacggcctgccaatcagcgccgccggccggctagcaggcccacacttgcatgcgcacacccacgcgcccacgcttccgcgcacgcccacacgcccacgcccacgcacgcacgtcacgccggcacgcacacgcgcacacctatctacccgcgggcaggcgtacatacgggcgcaccctactgcggtgggggcgggtagggttgtggcgtacggctgcatgcacgcccagcatcgctacccccatctgatctgcattgcgacacgacgaaagaacggcttgataccaccgggcgcggcggcccatttgcatgtagtgccgatcggtactatagcggtaatcgcccaacacggaacacatcaaaggcttggggcaaattgaaggcgacgacaagcgtggccggggactcgcaaaattaaagggcggattattgtattgacagtagtgctagacagtactattatcgatgccacctgaagaaaggtggcacgcatgggactaagggagatgcgtaagcgctgaggctggacacaggtccagctggccgatgtgacaggagtaccgcagaccaatatcagcgcttatgagcgatggtcggccgccaatccacgtggcaagataaaaaacccacataagatggagctgaccaccgccgtaaagctagccgacgcgctgggcggagacgtccaagagctactggcctagagcggcgaacgaaaaggggcccgacagtgctagctgtcagacccctgtgcccttagtctcaatcaatcatccgaatcgactatcaacgtggggcgctatctacagtagtagcctcacaaggaagtatgggtgcgcatgtcgatgggcactgcctgcgcggggacaaggacatcggacgccgccgctctcgcgaccgtcagcgcgacatgccgaagaaacgctgtcattgcagcgtttttacctcccctttttcggttttgtaatacacgttaaatcgtgtatagcagtagctaccaagcacggaacacacgagcgaagagcttggggagaacttaaaacggcagtcaccgaggtgactcgtgggagtgtgaggaatcagcccgatacggtgcgaggtacagcgcgggggcgatacagccgagaagcttgaaaattgaagagagacgacccataacatatttacacgcttcggcgtgtacaattggcctcgcaaggaggtcactatatgggactaagggaattgcggagccgcaagggctggacgcaagtccagctggctaacgccatgtcaatcccccagcagcgtgtcagtgagtacgagcgtgggcaggatatgtcatcatccagcgcgaaaaagttcgcgcgcatcctgggcgcgacgctggaagaggtcactgactacatcaggccggaggaatgagagaggtccgacagctgacactgtcggatctcgtgcccgtagtctcaatcggtctcgggaatcaacgacaatatggggcgctataggtagcaacctcacaaggaagtggggaatcgtgggaagggcaagcaaggcacgggcgcgcgggaagttggtgtatgctctacgggatgtaccagccttaatagcagggattgtagatagtcgcggcaggttgataagagaagcgccggtgcttgcgagcagggcgaatagcgctcatgaatcaagaccgagcgctttgacggagacttccggcggcaggcgtttcgttgcgctggggtgcatgtggacacggctatcggttgaactgcggaaaaccaccagccagaccgtggaagcatggcgggaatacgcttcggagcatgctggagtgcagcgcctgcaaggaggtgcggagtgagcacggtcactgtccggccgggctgcgcggctagactggagggacaacataggggaggagacggcatggcacgagtccacgaagtcactgacacaatctcgctgaggcctgaggaagccaacgccggggagaacatcgcccgacgggagggcgccacgctgtccagtcggctacaagatctcgccgaggcgtatgtggcgggtgacgacgccgacagcggcgtcagcctcaacagtcccggcgaagtgagggagtttttcggcaaccttgtcgaggaagccgcgtctgagagcatggggagttgaccgccggcaggttcggcgcggattggctcgccggcagatgagtcgccgcaagcatcaacatggaccgtcttggcacgttgctccaaggcggtccatcagctctcggtgaaggctttgaagaagagtcaaagatatcaagcaaggcatacaggagggtgcgaaagcacttgggggtaaggcaaagggcccttacgcgccttcctgcgtcagcgcttgaggcggtaggcggtggagttatcgggcatggggttcatgtgggtgtgcatcaggtggaggtagggctgggtggtgtccaggttggccgcgtcgggtgaggagtttccggggtcgaagctttggcatacgtcgttgttggggcagggggccacgcctttggggaagtagagcaggtcgaccggccagatggactcggccgtggtgcattcgccgtagaccttgtacgcctcgatgcgttcagggccgttgaaatccatcatctcgaatacgccgctcgcgcccgcgccgcgcccgtcggcgttagccacccagttgctgttgaaggagtacgtcagtttgccgtactgacggttgggtacgggcgtataggagccgtctttggcgatggtagtcgttttcggcgttgcaccaatggccggcgatggaggagaaatcaccattcctaatagcttgcgtgtcggccaccccggacgatgtggggggatgagaggcctccggttcggcggtgtcggacgggtcgccatccgcgtcggaggcttgttccgagccgctgaccgtacaggtcttgttcgccccgccggccacgtccaagcggcattggaagccagccttggcgtctttggcccaggagtcgtccaaaccgtcaaccgccgtttgcgccgtggagattttctgcttgagcttgttttcgtccgccttggacagcttatggtcatcgccggaccggtagtaggcgcagttggcgtcggggcaggccgcgccagccccctggctccaatcggtggtcgcaatgatgcggtcccgggactgttcggtggggtcgtcgctcaccagcggctcgtagtaggcggtgttgtagagtttggcgcctttctgcacgactagcaggaggtagtgtgtgtcggggtaactcccgtgatggttggctatcgctccatcctgggccagctggtgctgggtcgagggcatggagcgcatgatgcagtcgtcctgccccggctggcactcatgcagctggtagggcgggttggtgccatccacgggtgtctgcgggctcagcttgccgtcggaaatggtcatccaggcgccagcggggttggtccaggtgccctccatgctggagtagtcgcccctggcgatggcctccagattgagctgcggagggccggacagcttgtcattctcggttttctgccgttcggcggcggccacggctttctccacctcgctcaaggccttatcggcggtggatttggagtctgtgactgcctgggcggccttggtcaggccggcggccgcgtcggtgcaccggctggcgctttcggtgttgctggctgcggcctcgttgagctcctgggcgtctgcgacgttcgtgttcttgattaggcgcggtttggtggtctgcattccggtggccgcggacatgctctggtggtacgaggagatggtggaggcgtcggtcacctggcttttgcttaccttaccggctgagcgatcggcggacttgatcgcggcggacaggcccttgcgggcctcggtcaatttgttgagcgagtcgtcataacgggccagggcctgtgggcgggaatgggaggagtaatactggtagccgccgaaaccgccggccccaatcagcagtgctgcagcaatcacgaaagcggcgattttgaagccgtgtgacttgtgccgctcgaccgttgccgcaggggcagcggcttccgtgccgccaacgcctgcggcgaccatggcgggtggggcaggggtctggatgaccgtggtcggcgcttcggtctcctggaaatccgcaaactccgctggcagcgtttgcatccgcgtcccatcagcctcaccttgggcgacggccgcttcgccgtcgttctgctcgggtatggcatcagtgtgcgcggtatcggcttcgtttccgctttcctgctcgctggacccttgagttatcgcttcttgtggcgcgtcgccggctggtttccgctcgcttcggggcgtcttttcgttctcttgcgcaggctccactttcgccccgcaattgctgcagaacaaggccccgtcgtctatgcgcccccgcaattaccgcagaatcccatcgtctctcctcgtcgatgctcgctgcaggcgcgtcctgtttgcgccccgctttcgccattttatcggcagcgcagaaccggatagggcgccctggacaggggaaggagattctccgagtgtttggtgttcttgtgaataaggttatcgctggtgaaggaatctcgaacaaaccagcatccgtatgaagggttttcatatgaaacggacatacgcaagcctgtgcgctgggctgggcgcccttgccttatcggtggggctggtagccgtaccggcgttgaccgcgcaatccgcgcaggtaggggacaccgggcaagcggcggacgcgcaggccctggtggaccagagggctcctcgctactacggggacaatccggagacgatgattggcgtcagacccggcgttggaaccccggcaccccaggctcgcatcggctccaggagtctggtccgatcgggcacgcccgagaacgtgccgctcggacagcgcagcgaagcaccggtcgaaccggccgctaaaggcatcaccttctttgagaatccgcagactcgggtggcccagcagacgcccgtgtactcgccggatgtaaagccggtggtcagtccggcgggagaggtgaccggcgtgacgatcaatggtattgcgcagaattatgaaacttggatcccctattggtgcgacgtgagcaacgacggcggcaattccatgagcctgtgctaccgggaaaccaacatgttccaagaccaggctcagggcgcggctgtcggtgaacggctatccatcattgatgggaaaccgcatatcatactggacgatgagaatgtggacgcgggcatcgcccggttcctgggcgtcggtgcccttcaaagttccatgaaggattggaacacgctactcggtcaggactttttcctgctcaaatcccagacaacgaccaatgcgtccaatcctagcggaaaagccgtgattaatccggcccgtgactatattcaatacttgttcatcaagacggataattcgcccgatttcgcggcggcggccggtaccaccggactaagaattaacatgaacgaatataatgagggctattcttccctagccgatcgtgcgcccttagactatagcgattggggttattactttagccgtgaagaaaccagagctggtactttcaagcgtcgcaatgttgtgacttgggatgcagaaagctgctctatggggaattatgttggctcgtgtgtgcatgctcctaaccgagctgcggctgaacagcaatggcacagcatacatgccgaagactggaggaagctcctcgtgcatgagctcgggcatatgctgggtttggaccatcccacggatccgaccggtaccacttttaccctcaataacccgggaggcggctgcgcacccggacagcattactacaacaatgggccgctcatcatgcaataccagcgcgacaacggcgactcgatgcttgatgggaccatgtccagctcagtggagtaccggatggtgaaagacctgatcgcagcgggcacgaattatattaagcaggccatgcaagacggtcagcagataaggccagtcacccatcgcaaaatcagggtttccgtggtagatgagcacggtgcgccctcccgggtggcggcgccgatagccgaccagacccaaacggtggactattacggggtgtactccgatgtgaaaggggcttcgttctgtggcggcttcgacacgacggacatggacaagtggcagccctggggacaggcgccagcagtaaatgtgccggaattgcaagggtacgaggtttccgtggacggggggaggacgtgggcgagaaccgccaccataccggcggtgaacatgccgtcgacggcggccctgcagtggaattactcgctgactgggcggcggtggacctcggacggatcgaacgcggtgacgaacttcgggctggccgatttggctgatgtgagggtcatctaccgggtgcgcaccttggctccttcgccaggtgacggcggcagcgggtcttctcctgtggcgccctcgccgggtggcggcggcagcgggtcctcgcctgtggctccttcgcctggtggcggcggaccagccagcggggcgtcaaattcagccgtctcccaacagcggcaagtttacgctggctccgccgactctcatgagttggcggctacaggctccgatgtggtcattgtagcggccgcgggcggggtgttcctcctgctgggcggggccatgctgagcatcaagcgccgcatgcgctgattctcgagcccggaatgcgtttcggccccctatcttcaagcgctagggggccgaaacgcgttgggggctcttgcagccggcggcgggcggaggatgcggcgttggcacgggcggcgaccgcaagtaggggctgtggggtaggaatagggtattgatgatttcggtccgccgtgcgcggacggtgtggaaagcgagcggacgcatggcgttgagcaagaagcaggtcaagcagctacgggccctggcgaatgggatcaacccgaccctgtggatcggcaaggagggtgtgaccgaggccgccgcccagcaggtttcgcaaaccctggacgctcacgagctgattaagtgcgtggtgcaggacggcgctccagtcgacgctggcgaggcaggcaaggtcctgtccgagcggttgggcgctgacctggtccaggtgattggccgtcgtttcgtgctctaccgcgccagcgacaaagaggggatcaagcctatccaactggtccgcggctagggctgtgcgaatggcggaaccggaggggcgggtccgtcgtggcctgtgaggccgcacggttggggaatgaatggagggtgggaagatgacaggacgcgagcagtcagagcggatgggtgcgggctctgaccctgagaaggcgaaagcggacggggggccgtttggggagacgtatcatcgcgggtcggtgatcatgcgggggtcgatgattcccgaggataattcgaatacgagtctgttgactcctgatgcgaataccgattggctgcatatggacccctggcgggtgctgaggattcagtccgagttcgtggacgggttcggggccctggccgagttggggccggcggcggcgattttcgggtccgcgcgcatccctagtgacgatccggcctaccaggcggcgcgcaagatgggacacgacatagccgaacagggcatggccgtgatcaccggcggcgggcccggcatcatggaagccgccaaccggggcgcggccgaagccggcggcaagtcggtggggctgggcatcgaattgccccacgagcaggggattaaccagtgggtgaacctgggcatgaccttccgctacttcttcgtacgcaagaccatgttcgtcaaatactcctcaggcgcgatcgtctgcccaggcggattcggcaccatggacgagatgttcgaactgctgaccctggtgcaaacccacaaggtgactcgaaagtcgatcgtcttgttcgacacggactattgggaagggctcttcgactggatcgccggcacagtgcgcgagcgcggtatgatctccgacctggaccccgacttgctggtacgcaccgacgacccggaggaggccgtgcgtgtaatcgtggacagttataagagcggtctctgaaggaggggctgccaatccaaggatggttgggccccgcctccgctgggttcagcgctttgaagccagaaggacgccggtgccgattggcagcaggcacgcatccaactcgccgtcctgattctgctcgcagctttcggccagttggcgcaggagcaccgcccgtggggactggttggaggggttcatcacgcctccctcatcctcgttctccaagaagcacatggcatcggtgaataggatctgcccccgggcccgcaggagccgcggggcctcctgcaaggagtcgatgtaattgacatcgtcgccagccaccacaatcaggtcgtaatcctgggggttcagccggaggaagtaagtcttggcgcgggcgttcacggcccggagacgcaccccggttcgcccgctgagcgagcggaaagcacgccgaatcaggtccgcgccttgggaggaggagtccactgcggtgaactgtccagcgtctccgagcccctcgatcagacggagggcctcaaccaccgaaccggtgcctacgaggataatcgagcgcgcctggctggcccgggccaccacttccaggaaggcgccttgggccacggacccttgcgtgaagccggcctgcgtcgcttgcgcccgagccgccaccaagtagtccgactcagcgttgagtctgctgctttcggcgtattgccaggccttggcgtggttcgtgtagaaagacttatccatatcactcactttaaccaggccccctcacaagtgactggcggactcagtggattcaatcagcttccaaatggtttcccccacgtcgatgccccgggggcagggtcgggcgcaggcgcggatcgactggcaagcgcccaggccgtcctccctgtccaaaccattcaggcggtcctgggcgtgatcgtcgcgcgaatcgttgatgaagcgggccgctgctactagggctgcgggtcctatgaaggcctcgcctccggcgtagatagggcaggcggcctcgcacaggccgcaggagatgcaatcgctcagaagctcgtaggccttgagctggctcggagtctgcttcacctcgactgctggcgccccgggggagggctggtcgttctctgcgaccgtcccggtcccaagccaggggtggaccgccttgatttggcggaacatggcgtccgtgtcgaccactaagtcgcgtaggaccgggaaaccaggcaggggggccagctcaatcagctcgtcgccgacttcaagggcgttctgaggcgatggggggttttcgccgctcgtggcggggccctgatgttggggcaggaacctggttgtggggcggaagggagcggtgccttgggggtctgaccgcgcgcttccggcgacggtcgcctcgcacaggagccctggcctaccgttaatcaacacgccgtccgaaccgcacatgccgtgcccgcaggagtagcggaaggccaggctggggtcctgctggcgcttgattgacagcagacagtccaggagcgtgtcttggggttgggcggtgattcgatagtcctggacccagcgtttggcggcggacctgcgggtaggcgcattcgagccgctgctggcgaaggggttgctcctgcgcgcgcggccaccctgggcctgcgctcggggcaggggcttggaccggtggacccgtatcgttaaggtcgtgggggccgcgatgccccgttgccgcttgccttccatgccgttcgtcctctctgtgctctctggtcgcttgctgctccaggccttgtgatcgcgccctcatcctgttcgttgggacgagcggtcgtttctgggcttgcttgcctggggttcaataactgcgcgagccaggtggaaagtcctgtatatgcaccggttgccagctgatatggccgtcggcgtcgatcagggagtgctgcaggtaatgctcatcgtcgcggcgggggaagtccaggcgactcaaggagccccgggactcttgacgctccagactgcttttcaggaccgcccgtgccagtccggtcaggttcctgacttcgaagatggcgaccagctcctgattgaaatttggggaggggtcgtgcaggcttaagttttcgacctggctggacaagtcgccgtcaaggcgcgcctgcgcgctgctgaggctgtccgagtcgcagcgtacagcggctgcctgatccatgagccgcccaagtgactcgatgagctggtaggggttggaatcggtggacgcatcgccgtcgttcgcgctcccagctgtggttggggtggcggccgagtcgacggtttgggtggcgctgtcgagtaaacccgcggtttcgcgccgtcgttgcgatgccaggaggtccaagcggtccgattggaccgaatcgggctgctgggccggtgccgcagccgacgaggactgtcgctcagccagaatgtcctgtgccgcgctgcgcccggcccgccgtccgaagaggcaagcgtccaagagcgagttgccgcctaggcggttggccccgtgcacgcctacgcaggcgcattcgcccgccgcgaagagcccggctacagggaacctgcggccatcgttccagcggtagatccggccgtccaaatcaatcggcaggccgcccatcatgtagtgggcggtcggtttgaccggtaccaggtcgcgggtcggatccaggcccgcataccggcggatcgtctcgtccacctgagggagtttgtcgcgcatgtcttgcgctggaatcgcacgcaaatccaaccatacgcagtccttgggcccctggggttcgcgcgggtccgccaccccccgtccctggtcggtttcggccacaatcgcccggctgaccacgtcgcgggcagccaggtcccggtgctcgggcgcgtagcgggccatgaaggcttcccccttcgcgttgcgcaagacaccgccctcagcgcgggaggcttcagacaggaggattccggtatggcccaggcccgtaggatggaactggacgaactccatatcctccagttgcaggccagcgcgcaaggccagcgacatcccgtcgccggtcaggtcgtaggagttggagctggtgtggaagagacggcccgcgccgccggtgcacaggatgaccttgcgggcgcggatggcgtgcacctgcccagtgcgctcgtcccaagcgacgaggcccagggcttcatcgccggagtcggataaggccaggtcgcacacgtaccactcttcagcgaaagcgaccccgtgcttgaggcactgctgccagagggaggataggattcgatgcccgatgcggtcggccgcgtaggccgcgcgcttgaccggacggcccccgtagttggcggtgtgaccgccgaaccgccgctggctgattcgtccatcagcccggcgggagaaggcgacgccggctcgttccagatcgatgagagtggccttggcctcttgggccaggagtttggccgcgtcttggtcgaccagccaatcgccgcctttgacagtgtcgtaatagtgccagcgccagtcgtcggcctcctcgttgcctaggctcgcggctatgcctccctcggctgatcctgtatgggagcgcaggggctggagtttcgagaccaccaggagcttgaggggctcgccgttatcgtcggccacctctaacaggcccagagccgcggagaggccggcggcccccgctcctacgatgactgcgtcgtactcctgctcgatgttcactgggctcatgcctccgattctctcacagggccaggtcttggaggctatgaaaccccgtattccggcggatgagagcttgtcaggtcagcttggaaggatgaaggcatggcggattcagcgtcggggtcggaaccctctttcttcgaccgggtctacgcggtggttcagcgcattcccgagggcatggtggccacctatgggcaggtggcggcgttggctggtagaccacggtcggcccggtacgtgggttacgccctccactcgaatccgaccccaggagaggtgccttgccaccgggtggttttccgcgatggttctctggccccagggttcgccttcggcggccctgagcgtcagcgggaactgcttgaaggcgagggtgtggccttcaaaccgccgcgcgccggggaaaatgccggagcggatggttgggtggtggacttggaacggtccggttggacgaagtgaactgctcaatggcgtccacgctctcatcccttggttttgcgtctgctgaccggggcgaggacaccgccgacgatggtgatgagacctagtagttccatcgagccggcagtctgcatgaccgtctggattgaaggtgggccgtccgagccctgcctgtgagccagaagggccgcgatgttctcgcagctggcttcgattccccgagcttggcatgctctgatggctttcaccaaccgcgcctggtcgtctgtgggctgtgtcggctcctccgggatggaagcttgggccccgcttccatctcctgtctgtttccccgtccgacttcggcttcctgccatttcgagagcggcttggggttcctcccatctttctttgccttgggttcggtcgcgctggtttgcgggagcgggcggtgcaggcgctggagtggactgtcggtcacgcttgcccgggctctctggtaggcaagggtcgtgggcggcatggcagacgtcgctcaggtcggtggccgagatcagaatcatggccttgccctcgtgaatgagccggttgcagcctgtgttctccgggttgtcgatgctgccgggggctgcgtagacctcgcgtcccagctcggccgcccaggatgcggtgttcaaggctccggaccggtgccgggcctgtgctacgacgacgctgtgggccagggcggcgataatccgattgcgtagcaagaaccgtcgtgcctccggtatggtgtctgggcacagctcgctgatcagcgcgcctccttgattctcgatcgccctgaagaggcgctgattgctccgagggcccatatggcccaaaccgccagcgaagacggctaccgtgcgaccaggtcgtgggccgtacggtctggtcgccgccagggcgccccagtgggcgttcgcgtccgctcccatagcgccgccggagacgacgaggtggccgctctccgctgctttcagaccgacatgccgagccacgaaccgcccgtaagcgttacaggagcgtgagcctacgatggctatgggtctggggcaggagaccaaagccgccgggtccccccgtccccacaggcacaggggaggcgcccaatccgagcgcagggccaggtcgcccagctgggctggccagcaggggtggtctggtccgatgatccagtaagcgccaccaccgctgaagcgtcgttccagctcgtggacgcccaggccagccaaatccgccaagcgggtccgccattgggcgacggccctgtggaacttgcctacgtcgcgctggctggcacggtgcccccatcgggctgatccggagatgaacatgccgtccaggttgccttgggccctggccggagccgtttgtcgcgcgctcatagcgcccgtcgcgcttgttgcggtcgtttcgttgaccgcccgagccggtggcgcttccaaagcctccagcaaggcacaggcgcttccggctccaagcagggccgcgtagagcagggcatccggactgtcgatgcagtaggtgagcatggctctggccagggtctcggcggaaaggttcggcgcctgcgcctccggggcggcctgcacggtcggggcaaaagcgttcgcgttcattgcagcctcgttctcatcatgattccagcgttcacgtcctcggccctggggctggtccgcccgtccagatcggcaatggtccaggccagacgcatggcccgatcggcgccgcgcaggctcagccgtttgccctccagggctgcgttgaccaggctgatcgctttggcggatgtctcccggcgcagccactcgccggaggcttgcgcgttgcaggtccagccctgcttggcgaaccgggctcgcgccgccgccctggcttgggtggccaaagcgcggatttgggcgctggtgcgtctaggctcggtcgcactggtcagcagggaggagaccggaggcaccgtcacctggatgtcgattcgatccaggatgggtccggagagccggttccagtagcgggtgcgctcgcgcgatgaacaggtgcagcgctcgccggtaccgtagccgtagccgcaggggcaggggttggcggccatgaccagctggaaacgggccgggtaggaggccgtacccttggcgcgcgagaggaagacgcggccagtctccagcggctcgcgcagggtttggagagcgcgcggtgagaattcgggggcttcatccatgaagagcaccccacagtgagcccgggtgatggccccgggcagggccacgccggagccgccgccgactagggatgctgtggaagccgtgtggtggggcgcttcgaagggaggcacgtctgagatgccgtattgctgcaaatcgccgcatatggagcggattgaagccacttccaactgctctttttgcgccagtggaggcatgatcgagggcaggcgggaggccagcatggtcttgccggagccaggtggtccggtcatcagcatgtggtggccgccagcggctgctacggtcagggcccacttagtctgctcctgacctacgacctgcgccatatcgagtcgcttgccttggctgggggaattccccgccccgggctcgctcgaaccggtaggggtttgcgggcagtcggatgggtggtatttcgccttgccgcccacctgctcgatcaactcgcccaagtgacgcacccccactacatcaatgccgggcaccatccgcgcctcctccaagttcccgtacggcaggtaggcgcgcttgactccctgctcccgggcgtgcaggaggataggcagcaggccgttgacaggcaggaccgagccgtccagattcaactcgcccagggtcagcgccccttcgaaggcctgcccaggaatcgtgccggctgcgtccaggacggcgacggcgatggctaggtcgtggatggaaccgtgtttgggcatggatgcgggggagaggttgacggtcactcgggtttcgggccacttgaaaccggccgccgcgcaggccgacttgacccgttcgcgcgactcgctcaaggaggcgtcaggcaggccgatgatcgagaaatagggcaggcccggcgagatgaaggcttgggcttggatggtgaaggctttaagccccaccagccctacggacaggccggttccgatcctcatcagaaggcccccttgatcaggcggacccgggcttgggcgctgcctcctgccgcgctcggccccacgctcagggcggccacgtcgaagcgcacgccccggtggcggcagagtaggtcgtcatcgtgcttatcgagccagaggatggccgcatgacgcaggtgggagcgcttgctggcggcgacggcctcttcggggaggccataggcccggctgcgtctggttttgacctccacgattgccaggcgccgttccgggtccaaggctacgatatcgagctctccgaagcggcaggaccagttacggtccagcacccgccagcccatgctctccagccaataggccacgtagtcctcgccgagggcgccgaggcggtgggggctgatggagggcgcgcataaggcggcctcggtctgggctaggttcgagccggggtccggtgagtgacggtccggggtctgattcgtttcgcgtatgctatccatgcccccagtccaccattggcggggagggggagcgagccggggcggtcaatgtggtcgaacgtgccctagtgtggtcgaacgtgggtgagccttacccccgggaggtttcagcgggcccgccccaaccctggctgaccgggcgaatgggacggtcatgggtcatctcaatctcacggctcaaccagggcagtcatctggttcaggtcgagctcgaagctgacgccgcgcgcctcgtaatcaggctgagcctgcgtatgggacatggctgagcggacgaattcgccggcgattcgcgcggcttcgtccagggcgcgtccggcgaacagggctccgcacagggccgaggcgaacgcatcgccggtcccgtggatcatgtagggcagtttggcgtggacggactccaccttgccctgcgctccgccctgagcggccgaagccacgtagttgcgcaggcctccatcctcccgatcgatacctttgagcaccacgttgcgcgctcccatggccagcagggcttccaaacgcgcgtccacctgggcctcggtcaggttttgcccctcgtaaggcaatccggtcagcaaggaggcctcggtcaggttgggcatgagtacgtccgcgccgtccaccaggccggctgtggccaggcagagctcatccgtataggtggggtacatctggccgccgtcgcccatgaccgggtccaccagccgcagggctttggggtattgacggtacatgcgctggatgatgcccacctgctcagccgatcccaggaacccggagtagatgccgtccaggtccacgccttcctgccgccaagcatccaagtagccaggcagcatgtccgtcgtgtcgtggaaggtgtagtgctcgaacttggtgtgggcggagaacagggccgtgggtacggggcacacatcgcagccggccgctgacaggatggggatcgccgcggtcagtgagcatttgccgtagccgcacatgtcatgcagggcggcaacgcgcggaacgtaatagcgttggcgggtgtacagggtgttctcgttcatgctgcttccttcgttcggcgatggcatgggcgcggatgacggtgccgggtgatggtgcttatggctttcgccagcagattctaccgccaactgtcggcaagggggtcggatggttaatagacggaagcgggccccgctgttggatcacagaccccttggcggcttgtcatccttgaggatgagaccaggggtcgcgttgggagcgcttatccgctgcaagttcagcccctgggatgattccggcggctgtcggcgctggatagattgagggcaggaagcgcagggaggacttgcgcgacgcactatgaagggattgaagatgacgaatctgtcagggaaccagggcgcgacgccgacggaggcgcagggcatgccgccgaggccagtggagggcactgcggtgcaggccattggattggtcaaggattatggaagcggggagaacctggtccatgccctacgcggggtggacgtggccttccagcgcggccgcttcaccgcgatcatggggccatccggctcgggcaagtccacgctgatgcacaccctggctgggctggattccgccacttcgggccgggtcctgctctacggggtgggctccggcggcgaatccggctcacacaggcgcgcgaccaaggggggtcggatcgacgggcatagctttgtggacatcaccaagctgggcgacaaccagctgaccctcctgcgccgccactcgattggcttcatcttccagtccttcaacctcctgcccatgttcaccgcggagcagaacatcctgatgccgctgaccctggagggcgtcaagccagacagggggtggctcgaccttctggtgcggaccctggggttggaagggcgcttgaaccaccggcccagcgagctttccggtggccagcagcagcgggtggccatagcccgcgccctgatcgccaaaccggccatcgtcttcgccgacgagcccaccggcaacctggattccgtctcctcggccgaggtcctgagcttcctcaagcgttcggtgcgtgagttgggtcagaccgtcatcatggtcacgcacgatccggtagcggcctcctacgcggaccgcgccattgttttcgccgacggacggatcgtggccgatgagggccagcccaccgccgatcggatgagcgagctgctgaaccgacaggccgagatggtggcggcgatcggttcggttgggccgatggttcagccgcaggcgcccgccgccagccaccgggccaactgagcgcgagaggaaggcaaacatcatgtggtcagtatcctggaaaatgatgaagcgcgacgggcgcatgctggttcccgcaggcatcgccatactggtcggcagcctcttcatcgccgccaccttcctgttcggcaactccatggacgcgtccgtacgcaaacaggtgtcctcgtcattcggggaggccaactacgccatcgcgcccaatgccgctgtcagcgacgccgattcgggtggcaagaaggttaaggacttccatcttaaggagatcctgggcctcaagggggtcgagggcgccagggcggacgtattcgcgcccgtagagctttcttccagccctgccgataaacacacgaattcggccggcatcgccatgagtcatcctggttcaatcatgcccatgccgatcgttgaggggcgttggccgcagggggattccgaaatcgccctgcctaagcaagccgcccagcgtttgaatcttaagatgggggacgtcgtcagcgtaaggcccgccgcaggcggtcctggtaattccggcggcgccggcgacctgcggctcaagctggtggggctgaatgaggatacggatggtgcgtattcctactatggaggcgcgagcgtcatgggtgagggtaccatggcccgtctcaagggagaccccagccccgtgggcgtcgacggctaccaggctccgtacgtctatctgtccattgatgaagcccaagcggggcaggccaccctggagcggatccgagggcagctgcccaagggtttccagctgcagacccgtgccgcttttgaggattcccaaatcaagcagttgagtgggcagaccaatatcatgaagaccttcctgctgagtttcggcgtcctggcgatgttcgtggcagcgttggtcatcgccaacaccttccaggtaatggtggcccgccaacgccggaccttggcgctcttgcgcacgatcggcgccaagaaggggcaggtgagggcttcggttctcatgcagtcaagcattctggggttgatcgcctctacgctgggcgctgtcggcgccatcggagtcatggcggcggcccatgccctgggcctgagactgggcgccctgaccttggctgtggtcgtgacgccggcggtcatcgtggtgcccatcgtgttcggcaccgccatgaccatgctcgcttccctcagttccgcggcgaccgccacgcgggtcacgccccttgaggccctgcgcccggccgaggtgagtgggaacggcaagagccgcgggaggatccgcttcgccctggcaggcctcatgatggtcgtcggcgcggccatggccgcttggatcgtctaccaggcggtgcaggattcgcgtggggtcaagggcacgatggtgtccggcgataacgcggatgcggcgttgggcatcgctgttgctggcgtggccttgttcttcattggcgtcctcctgtgcgccaaccggtggattccatggatgctcaaaggcattggctctgccctggcgcatgtcggcccttcgtccaaggtggcggtgggcaacatctcgcgcaacccggctcgtgtagcggccaccggcacggccctgctcataggcgtcacgctggtcgcctgcctgggcaccggcgccacttcggccaagcggaccatggcggcgaccctggactcccgctatagcgtggacgtggagatcgccttggaaaaggaggaccagggcagcctcgataaggtgcgtaaggtcaagggcgtgaaggccgccgacatcgtgccggtctaccagggcgccctcggctcaggaaagaccgccgaaagccatgcggagaagtcgtccatagccatcttcggcctcaagccgggccagtccgaacgcctgatgaacgcatcccaggaatcgctgatggcgggcggggcgaaactggtgatgccccagggccaagtcggaggcaagaacgcgctgaaggaaggggataccgtatcgacggtccaaggtaaggatggcgcttacaccgccagcggtcattccttccaggtggtgcccggctccttcaacggcttgggtggcgactcaggaatctatggaatcgcgcttatcgaccagcccgtcggactgggtgcgcctagccagtatgagatctgggtcaaggccgatggcggccagccggtggggagctttatggaagacatacgcgaggccatgagcacgactgcgaacgcggcggtctcgggcggcatcgccatgaaagccacctatgagcagatcgtcaacatcttcctgctcatcatggtggccttgttggcggtggcggtggtcatcgcgctgattggcgtggccaacacgctctccctctcggtcatcgagcgcaccaaggagtctgccaccttgcgcgccatcggcatgacccgccgccagctcaagcgctcgctctcaatcgaggccttgctcatcgcggtgggctccacgctcgccggcctcgtcttgggtacgctgttcggctggaccggctcgtacatcgttttccaatccctgggcaaggtctccctacccttggattgggggatgtatggcatgatcctggtggtcgcggtcatcgcggccctgctggcgagcgtcttgccggccaggcgcgccaccaggaccccgccggtggaggccctggtggaagcctaggggaagaaggggctgcaagctcactggaggtaaggctcgggggcggtatccggcatcagcatcggataccgcccccaagcccttacttgggttggccgggcttatttccaagcgcgcccggcccgcttgccgcccgccgccctcagaccaggtggttgtcataggcgaagaccacggcctggacccggtcccgggcgtggatcttctgcaggatgtgcgccacatgcgtctttaccgtgggcagggagatgaagagctggttggctatctcctggttggataggccatgggcgatctccgccaatacttccagttcgcgctcggtgagctcgttgagttcagggtcccggtaatcgctggagggagcgtagccggtccggccagtgacggattgccttttggggctctgtgggtcgaatccagcgctgtcgtacgcgccctgggccatgcgctcgatcaaacgttttgtggctgatggggcaatgatggcgttgccctggtggacggtgcggatggaggccagcagggtctcaggctcggtgtccttgagcaggaagcctgaggcgcccgcctggatggcggccatcacgtattcatccaagtcgaaggtggtcaggatgatcacccgggtcaacctgcggcaagggtcatcgcccatcgacgctggggacggcgtcagttggcagatgcgcttggtggcttcaaggccgtccatgcccggcatgcgcacgtccatcaggaccacgtccggtgtgaggcgctggactaagtccaccgcctgctcgccctgggacgcctgccccaccacttccatgtcgtcctgggatccgatgaccatggcgaaaccggcccgcaccagatcctgatcgtcggctatggccacccgaatcggtccgcttgcccctcgtccgcccacgttcaagcccacttccaccttggtttcctcgctgtccatgctagacgagcgcatctacagccagacccctcccacggcatgattcacgcagctccctggccgcccgcctccagagtcaggcctcaggaggattcgacgggatggagtcggagggcgggctcattctctttggattcctggctcgcgtcggagctgctggtctggcgtaggatgtccaaaagctggcgcatgcgggccagagcggcccggcccgcacggccgatttcctcaaaggcctggtcaatggcttcagggctgacaccggaaccctggccatccgcttttcggatcatggcgataccagcgttggcccggccaatcacctggctcagggtggtggccacctccgcttggatttgcgcgccgatgcgggcccgctcggcgttggcggccagtctgcgccgctgggcctcgccctgcaggagcgcctcctgccgttcccgctgcaaaatcaggctggagccggacgcccgccgccacagccccagtaccagggcgcaggcgcaggtgatcgcagtggtcgcgagcagcgccgccgccacctcgctgggcgagccgttgacggccgcgcgcggcccggagcggtcccccaagacccaagcgaggatgctgggggagctgtaccggacctcgcagcgcaggcgtacgaacagcagcaccaggtcggctaccagggtcgccggcacccacagccgcgtcttgcctcgcccataagccgccactgaatagatggagaccaggaccagtgtgttggccgtcgcgatccaaggcacggccagcagctcgagagtggcgaccgaggctaccagcgcggcgctcgcattaggcagccggcggcgcaccactagcggcagactgatgcagacggtctcgatgatggccgcgggcagggggatgtaccggcccggggagtccagattggcgtcgagtgtgaagtaggtggcgttggaggcggtcagcaacagcagcaggggcaggatcagcagaccgtccaccaataggtagtgctcggcggtccaagcggacagccgttcgatgcggttacggctctcgccgggcccccgctccaaatcgcccttatccgcgaccaatcccgtgacttccacgggctcgtccgtccgcctatcggtgccatcgtgagcgctcgtggccatgcttccgcctgatcccaggggtatggtcacgtccacgctgaacccgccagccggacgggggccggccagcatccgtccgcccagggcttccacccgctcgctcatgccgattaggccatacccctggtggtccccggtttcaagagcgtcggccgcgccccgcccgtcgtcgcgagccacgagcctcaggccgtccgaggaccaatgttcgctgatttgcgcccgcgcgcgaggaccggcgtgctttcggatgttcgacagcgcctcctgcacgcagcggtaggccgctagcgatgccttcgcgcccagcttgtccggctccggcttgccttctacggtccgttccagggtcagaccggggctggcttgccgggcttggcgcaccaaatcgtcaatgccgtcgtagtactcagcggcattgatttcggacccgtccccgcttgccggccttcgatcgtgggattgccctgcggtatggccgcgcctgccaccaccggtcgtcgcggccgtccgcgtatgcgcgcccgtacccgtgcgggcatcgctgtccggcgcggacggcgtatcctcttgcccgtcgtcggtgaaactgccgaagagtcgattcatgtcgtgtaaggcccgcccggcctcctgacggatcgttcccatcacccgcagggctagtgcaggatcccgtgtccccgcgtaccgtccggcgtcggattgcacaatcacgattgacagcgtgtgcgccaccagatcgtgcatatcgcgggctatgcgcgcccgctcggctgaggccgccaagcgcgcctgctcccgctgccggtactctatggccgcattgcgctcacgcatggccgtcagcgcctgcttgcgcgatcgatcccaaaaagccaggaaaaccaccaggagcagcagcagggctaaggagagcaggccgagccccaggttcagcgctatctgggggccgcaggcccagatggattctcccggcttggtctggcacacgggggtccgcgcttgcccttccgcgggcgaggccggtcgcgagcccaaccgggagagcggccccaagttgttgaccgtggcgtagagcacggattccagggtcaccagcgccgcggccaggatcacgtaccgtctgctgcgccgccggtccccgtagaccagggcggagtagagcatgatgagtccggtcgcgtcggctgggatgagcgtgggccctactgccagctgcgccaggacgatacagacgaagatgttggccgccaggtccggtcggctccggcggatgaccaggggcagcaccagcagcaggccgaacagaatcgctactggtcggctggtgggggcaaggaagccgtcgcccatgattggtgaggccgcgaagagtaaggacaggaagatgacggccagggccagcaggccgtcccgggccagcaggtgggaccgccaccaggacaccaaactgctgcaccatgccttcgctgtgttcataggcccagcctagcctcctgcgccaccgcccaccctcggtccagaggatgattccaggacccgccgccgtgggcgggaggcgtaatactgcgcgaatactatacgtactaccctgaggtagacggtgcggggcatccggcaaggtgcgtacgcgagacgggcaaggcagtaaaggggggatatgacacgcttggcttcctattacgcggccggcatgcaggtcgaggagggctcgctccaggtgccgttggattggacgggccacactccgggcgccgatttgggtccaggccccaggatcggcgtcttctatcgtgtgctgaccgaccccgagcgcactcacgaggacctgccgctcctggtgtacctccaaggaggtcctggtgcccccgccccccgcccgctgagccaagacgacgacccgtggatcggcgcggccctcaaacgcttccgcgtggtcctgcccgaccagcgggggaccggccgctccagtccggtggacgccagctcattcgccgcgcttggcggaccggaggaacaagcggcatacctgcgcttgttcctggccgactcgatcgtgcgcgacttcgagcacatgcgcctgaccgagtttggcggtcggcgctgggtgtcgctcggccagtcctatggcggtttcctgacgctggcctatctctcggccttcccccagggcttggcggcctgcttcaccacaggcgggataccgcatgtgcctgcgtcggcgcgcgaggtctacgagcacaccttcccgcgcatggcggccaaaagccgggagttctacgagcgttatccgcaggacgtcgaacgggtggcggctatcgcggaccggctggctgacggtggcgtgaccctgcccagcggcgacccgctcacggtcgagcgcttccagaccctgggcgccgacttaggcaagaagccggccttcgagcgtctccactggctcctggacacggccttccccgacggtgacggcagcctatccgcagctcgttcggcccgcctgtctgacaccttcctggcgggcgtggaagaggccactgcctcaaccccgctctactggccattgcaggagttcatttacgcggacggcgagtgcgggccggtcggatgggccgcccagcaggtgcgcgaccagagcccggaattcggggtcggcgctcgccccctcttgttcacaggcgaggccatcttcccctggatgttcgaacaggaacgggcgctgcgccccttccgccaggcggtccagctgctgatgggggagggctcctggccgagggtgtatgacgccgctcagttggaggtcaacgaggtgcctctccaggcggcggtctactacaacgacatgtatgtggaccgtgagcttcagctggacaccctttcacggctgggtaattcgcacgcctggatcactagcgagtacgagcacgacggcctgcaccagtccggcatgttcagcaagctgttgcggctggccttggagcgtggcgacttggaaggcgtgctgtaggcctcgacgggcgctcctgcgccggcgcgttaggattggacgggtatgaacgactggagggcgcgcggatcaggcgggcccgttgagagctgagggatggatatggcaagctcgaacgtgacgattggtttcatcggttatggcaacatggcccaggccatcgcccaggggttggtcggcgccggcgtgattgatggctcgcaggtcgtggcgaccaccccgcatttcggcagcctgcaggcagcggccgagcgcatcggcgcccgtccggtgcgcaccgccgctgaggtggtgcaagcttcggatattgtcgtcgtggcggtcaaacccaagcaggtggaggacgcgctggccccgatcgtcgacgacctggacgaggatggccgcttcgtgctctcgattgtgggcggctacacctactcctggtatcaggacgtgctcaaggccgacacccacttgatttgcgcagtgccgaacacgccgatagccgtgggtaagggcattctagccactgagaccacccatagcctgaccgccgaacagtaccggacgttcaaggatgtgttcgggccagtggccttgatcgaggaggtgcccaccgatcagctgggcatcgccacgaccgttgccggttgcgcgcccgccttcaccgccatgtacatggaggctctggccgacgccggcgttaagcatggcctttcccgcctgtccgcttaccggctggccgcccagatggtggaggggaccggcgccctctacctggccaccggcaccaatcccggcgccatgaaagaccaggtcacctcgcctggcggcaccaccatcaaaggcgtggccgccttggagaaggacggtttccggggcgcggtcatcgatgccgtggacgccatcgaaggcgaataagccgaaacccgcccgccgtgccccgtataagtcatatgtgcgaatagactgggagtcatgtctcttaccatcggaatcgtcggcctgcccaatgtgggcaagtccacgctctttaacgccctgacccgtaacaacgtgctggcggagaactaccccttcgccaccatcgagcccaacaccggcatcgtgcccctgcccgacgcccgcctgcccaagctggccgaactggtgcattccaataaaatcgtgcccgcgaccgttacgttcgtggacatcgccggcatcgtcaagggggcctcagagggcgagggcctgggtaaccagttcctggccaacatccgcgaggcggacgccatctgcgaggtcgtgcgcgccttcgaggacgacgacatcgtgcacgtcaacggccatgtggacccgtccgacgacatcgagaccatcaacaccgagctcgtcctggccgacatgcagaccatcgagaacgccctgcccaagctggagaaggacctgcgcggcggcaagatcgagcagtcctacctggacgcggtcaagcacgcccagcagatcctaggcgagggcgagaccatcgaccacgcggccgccgccggcaagatcgacaaggccgacatctacgatttgcatctgatgaccgccaagcccttcatctacgtgttcaacctggacgacgacgagttgcagaacacggacatgcaggccaagctggcggcttcagtggctccggcccaggccatcttcctcaacgcccagttcgaggccgacctgaccgagctggacgaggccgacgcccgcgaaatgctgaccgacgccggcctcaaggagtccggcctggatcagctggcccgtgtgggcttcgacgtgctgggcctgcagaccttcctgaccgccggtgagaaggaagtgcgcgcctggcagatccaccaaggttggacagccccccaggccgctggcgtcatccactccgacttcgaaaagggcttcatcaaagccgacatcgtctcctacgacgacttcgtggccgcagagggctcgatgtccgcgatcaaggaggaaggcaagctgcgccaagagggccgtgattacgtgatgcagcctggcgacatcgtcgaattcaagttcaatgtgtgaggtgaggggtgcgaacttcacactccgaaccaaaaggggtaggccccgttgtcggcgtcgccggtagcggggcctacccttatgcggatgccagtctgcctgctcactgtccgatcaaggagatgcgctggaaggggtgggcggccgattcggcctcgtcgactaaaccaatcgcgtagtcggcgtaggagatggaggattcgccgcgttcgttggtggagtattcctcgccccgcaggaggtacttgccggtgcgcgggccgtcggcccggaagtcggccgccgggctcaggtaggtccaggtcacgtccgagcgcaggcgcagctgctccaggctctggctcatgatcttggccagcgggtaggcctcgcgcgggaagtcgggggtgtccttgagctcctgggtgtgctctggattgaggtagaggctgcctgccccacccaccaccagcaggcgggtggacaagcccgtcagcgcatcgcacaagtgcttgagcgaggtcatgtgctcaggcaggtcctctagtttgaaaacaccgaaggcatccacaaccacgccgaaaggtttcaagtcggccgcggtcaggtcaaacagatcctggcgcagggtgtgctgggcctcggtcgtattcttgtgacgcaccagcgctgtcacgttgatgccgcgccttacggcctcgtgtacaatcgccgaacccgccttaccgttcgccgctaccactgccatgttcaaatcgctcataacccttcatcttccttctagggcggatgcctctggcttgcccgtcgtctgcctacacgcactaccgtacaaccttgctgccggacctgccgtcgactcaccgccgcgaactcgtcctccgcggggcgtggccgccgccctgtcgcttacagggccatgcccacagcgaaaccgcctgcgactgccagcaggggagcgatcatcgaggtgagcagagagaggccggcctgcccaaaccggtgggtccgtgtcagggacagggtgtctgcaatcgcggtggagaaggtggaaaagccacccaacaggccggtggcgagcaggaggtgggcggtcgggtcgagcaggagccgggagctgaacgcggcaaccaggccggcgaagcaggaggcgatcaggttgatgaccagtgtggaccaggggaaggggccgtggctcgagcgcttgatggccgtgtcgagcaggtagcgggcgccggcgcccacgccgccacctaggcagaccagcagaaccgtcattgtcggacctgacgccatgccgccagtcgcgatccgcagcggcctccgacccaggccaggcccaggccagcggcgaacgtggccagtaggtaaagggccgcggaccagaaatggaggtcgcggccggtggtgaagacctccaccatcaacgtggacatggtggacagcccgccgcacacccccatgcccaaggttctgctgattcgctcacgccgtcgctcaccaatccatggggcgccggccaggtatgagctgagcaggcagtaagccaggcaggccagcatattggccgcgaacgtgccggtgtagaaataccaggagaatgagcgtaagccgcccagggcgtaacgcaggccggttcccgccgcccctcccgccgccaccagcagcaggctggaggcatggaaggaggagggcgagaagggcttgtcggtcgtgcttgtcatgctctcccttccgttgccgtcgcctatcatgctagtccgtggcgtcaggcccggtcatcgccctcgccgaccgtggcgggcgccttgttctccgggtccagggtcaggcggtcgtcatccgcgtcgtagtcgaagagttcgccgtagcggccccagctgatcgcggtctcgaactgctggacggcctccttgtcagagtggtgggagcgcaggaggtccaggatcagcgaaccatgcaaggtcttgctctccgaattcttcaaggcgcggtcgatcacgcgtaccagcggcacatgctccagaatcatcgaggagaacatctccttggcctgcaagatgtccgcatgctgccagtcgcggcccagcttggtcaggctcacatggccgttgtcggcgtcgaagatgcccagcaggagccctgcgtcgatcaatgggaagaggtcgtccacttcgaagttgagcttggccgccaggtccgccatgtcgatgccgtcaggatgctcggacattacgtcgaccaggccggcgagcccgccgggggtggcgtcgggcaagacctttttgcccatctcttcctcgcgcaccgagttattgatcgcctccttgtcgcggaccttggactggagcttgcgccgtatgtcgcctttgtcggagcggccggtcagcacggcgtagaggtagtcgaccgtggtctggaactcgtcggactgcttgtcacgaggacggggcagcgtaatcggcacctcggcgatgatatggcccgggtgggagcccagtacgacgacccggtcggccatctgcacggcctcctcgatgttgtgggtcaccatgagaaccgacttgatcgagtcggactcggaggaccagaccttcaggacctcctggcgcaggttctccgcggtcagcacgtcgagggcggagaagggctcgtccatgaagagcgcgtcgggcttcaagaccagggcgcgcgcgatgccaacccgctggcgcatgccgcccgagagctccttggggtaggcgctttcgaagccgtccaggccgattgagtcgattgcggccagggccagcttcttgcgggtgtctctgggcacgccccgggcttgcaagcccagctccacgttggcctcgacggtcagccaaggcatcagggcgaaggactggaagaccagggccacgcccgggttggggccgtccagttcgtgtccccggtaggtcaccgaacctgagctggccgggatcagtcccgccaggatgcgcaggaaggtggacttgcccgcgccggagcggcccaggatggctacgacttccccctcgtgcagggtgaaggacatatcgtctaggaccttgagctcattgccctggtcggactcgaactccttattgacatgacgggcttcgatgatgttggttattttctccataatggtgctccctgcaagttctcatcgggaattcagtcaatatgtctgtgcggctcgtccgcgtgggtcggagcgctcaagtcgcgcggctggcggcggctgcctggcttaggtgatggcgtagcggcgctgagccagagcctggataggggaccagcagaccttgttcagggcgaccacgaaaacgctcatgacggctacgccggcgatgatcctgggggtgtcgcccaccgcggtggcttcggctacgtaagagcccacgccggtggcggtcagggtgtgcttggcataggagaccacttccgagacgattgaggcgttccaggcgccgccggacgcggtgatgcctccggtgcaccaggagttgaagaccccaggaaggatcagggtcttccagcgctgccaggctggctggcgcaaggagcgtgacatctcccgcaggtcatcggggatggccgaggcgccggcgataacgttgaacaggatgtaccactgggtgcctagggccatcagcaggatggacccccagttgatgtcgatatgccaggccaggaaccacatggtcacgaaggggaagatgaagttggcggggaaggaggcgcagatctgcaccactggctgcaggatgcgggagagcttggggttcaagccgatcatggccccgattggcacccaaatggctgagctcacgataatcagcagggtcactctgagcatggtgaggaagcccaggacgaagacgtggcccacctccgagaagcctaaggccggtacgaccagctggtagagcttgaacaggccccatgcgccgaggagaccgaggaccacggcatacaggccattggagaacagggtccgcctccggtactgccctgttgaccagtggcctcccgtgacccccagcggacgggtcagacggtccaggaatccgctgatggggcggccgatccggcccagcaggtcgctgatccctgataggcgcaggacggtcaggacgatgctgcgcttgggctcggtcgattcgctgtcggccatgcggaacttctccgcccaagcggtcaacggcttccacaggaggaagtcgatcaggagcaccaccacgaccatcgtcacgatcgccaagcccacctttcccagctccttctggccggcggcctcctctacgtaggagccgatgccgggcagggccatagtgcggttattgaccgaaatcatttcggaagcggtcaggaagaaccagcccccgcccacgctcatcatgcagttccaaagcatggggatcatcgaataaggcacgtccagcttccagaaccgctgccatcgggtcagccgcagggaacgcgccgcctcgtccagctcggtgggctcgttcagcaatgaaccgtagaaggagaaggtcatgttccaagcctgcgaggtgaagatggcgaaaatcgaggccgcctccacgcccatgatcgaaccggggaagagcaccagccagatggagatcgtggcggataggaaacccaggatgggtacggactgaaggatgtcgagcaagggcatcaggatcgcgcgcgcccgcttgctcctggcagccgccagcccgtatatgtaggagaagaccagggagacgaacagggcgaggaacatgcgcaggaccgagcgcatggcgtaatagggcaggtacttggcgtcggtggagatgtgctcggggatgccctgggggcctatgggcgcgcctagagcgggcaggaggtatcccaacgcgccaaagaaggccagtacgccgatggcgacgaggacgctggagaccaggcggcttcgacgggaagcctggctgcgctcagtcggagcggaggacaggccgcggatgggattggtaaacggagtcataagcagtctctttctcgttcctgtacggcctcacgcgacaaccgaccggctaagctcgcccagcccttaggcggctcgctgctaccggtaggccaggtgcgggggaagagggaagcgcgataaggcttgcggttgatacggacgaatgcaagcgctggtgccgactgatgccgccatgcggccattactgtgatgcggaacgtcgtccatacgcctcgcctcctttccgatgctgactgcctgacgtctgcgtaggctcttgaggacggcataggaggtggggctttaagctccttgagactccggtcgttcaagcttcggcttcgcatggcgttcgggattgcgttagtccccgccttgattcgacggggactgctgaccagcgcggagtgtctccattcctttgcggcagcaacccatgtccatgtggtagcttcgcctaccgactgcacccctaagataaaggtcctggctaggcttgtcaaatcgtcgtccgcagggtgtaagggcggtctgcaggggcggcaggtctgcgcctgagcggacaatggtgcctggtacgggcggctgggcggattgcctgacgggcccgctggcagcgttttcagtcctattgcgcataaggaggcccggcatgaaagccgtcgcaattaccgccaaccctgagccgaggagcctgaccgaggcgatgggcaacgccttcctggacggtgcggctgaggctggcgccgacactgatttaatcgatctttacgctgagggcttcaatccggtctattcgatggaggaccgcctgcactacctggaccagggtcccctgcctgctgatgtggcggccatgcagaaccggatagcggacgccgatgtgctggcttttgtttttcccatctactggttctccctgcctgcgctgatgaagggcttcttcgaccgggtgctttgccgccggttcgcctaccatgcggacggtacgcctggggccttggcaggcaagaaggtcaggctgatcatgctgtgcgggggagaggaggcccgcttccgttccgacggggtggacgcggcgatcgacacccagctggtccagcgcacgctgaacggctactgcggtgtggacgacatcgagaaggtctatatcgaccgcttgaccagcggtgacgatgacccgcaggtgcgtgaggaaatcaagcatcgtttgattcgtgtcaccctgatggggcggaagctggctgtggaaggcggggcgtccaaggtcggcgagcgggcatgaggccgctgaaggtcggttttgtcttcgacgacagcctggacgcgttcgacggcgtgcagcagcacattctgaccctggggcgtgaactggagcgccggggccacgaggtccattacttagtggggcagaccgagcatccaccggtcaggcatgtgcatccgctgagccgaaatgtgcaggtctcctttaacggcaaccgtatgcgtatccctctgttggccccgggcgatgccattcgccgtgccctggcggcgggccccttcgacatcctccatgtccaggccccatacagccccttgcttgcgggtcgggtgttggagcgggccgacccaaggaccggtttggtggccacttaccacatcgcggtggatactcgggtccagctggcggctggcaaagccctgggggccatcaacagccgcagccaccgcttgattgacgaggtcatcgcggtctcgcaggtcgcggcccgctatgcccagctgaccgctggcgtgcgaggggtcgtcatacctaatccggtggacgtgacaggcctgcaggagcggggaaggtccgtgggacgcgagcgggtggagcgcctgcatggccaagggccgcacttggtcttcctggggcggttcgtgccacgcaagggggcgagggccctgctggacgccctggcctggggcgaggccgccgaagtctttccccccgggctgcacgtcacgatggccggtaaaggccccctgctggaggaatgccgacggcgggcagaggagctcaggaccccggtggagttccccggattcatcgaggaaggagacaaaccggccctgctggcttcagctgacctggcggtcttcccttcgaccggcggggaatccttcggcattgtcctgctggaggccatcgcctccggggcagcgctctccttggccggtgacaacccgggatatcgttccacgctcctggatgacgaggacgccttggtgccggtcggcgacgagggtggtcaaccgggccgggccctggccgagcgcattgcccgggccctcgccgaacccgcctggtccgaggccttggcccggcgcgaacgtggcctgctgaaacgctacgacgtcaagaccgtggccgcccaggtcgagggggtctatgcccgggccctggcggaccgggggagggactgaagacgccggtgccccgctttcggaaaggacgtcgcctgcatgtaagcttggcgtatgtccttctttgatatgttcggcgccatgttcgaccccgatcgggaccctcggtctcgccggccgggccgctcggacgatgatttcgtcatccttaacgtcgaggaggacggtcgctccggtccgcgagaggggtcaggcggtcggcgggggccaggcggccctggcatgcctcgcatgccccgtctgaatcgcaggccctcttcgggcccaggcctgagccgggggtcgaagatcacgatggtcgcggtcggggtggttgtggccttggtcattctcctgttcgccaccgcccgcttcatcaccgatttgatgtggtactcccagttgggtgccgcccgagtgatttggacccagctgggggttaaagtcggcctctggctggcctacgccctggtcctggccttggtcaccctgtgctccgccgccttggccatccgagccaggccagactcgccggacggttccacgatccgcatcaagggcgacctgatcgaagtgggccacggggtctcctctaagcgggcccgcaggatcgccgggctggtctccctcgccgtgggcgtaatcttcggcttccaattcaatgccgactggacccaggtcttgctcctgttcagccgccagtccttcggcgcaaccgacccccagttcggcctggacaacggcttctatgtcttcaccctgcctggcttggagctcctggcctccgccctcttgctgatcgtcgtgctggcgggtttgttctcgctgatcacccacttcctgatgggtggcgtgcgcctcaccatgccggtgcatgggcgcggaatcgtcgagatgacccgcaaggcccgccaccagctggctgcctggctgatcctgattatgctggtctgggccggcaatatagccctgggcgttttcgaccgcctgaccgagcagggcgaccaggcggcgggcgcctcccagattaccggcgcctcttacacctcggtcaacgccaacatccccgtcaccttgatcatggccgtactggtggctttggtcggcatcatcctgggagtgtggctgttgacggccaagaccttgggagagggccgttcctccgccaactcggcgggtcaggcccttaagcagtggcgcctgccggccacagccatcggcgcgctagtggtcgcggcgatcctactgaccggcgtgtggccgatggtggtccagcgcttccgggtgagccccaacgcccaggagatggaatccaagttcatccagcgcaacatcgccgccacctctgaggcttatgggctcaaacggctgaagacccaacagtaccaagccaccacccaggtgcgtccgggagcactggctcaggacgccgacaccacagcccagatccgcctcttggacccgcaggtggtgtcgcccaccttccggcaactccagcagtccaagcagtattacaccttcgaggacaccctcgccgtcgacaaatatgagatcgacggggtcagccaagacacagtgatcggagcccgcgagctcgacctggagggcaacgacaaccgcaactgggtcaatgaccacacggtcttcacccacggctacggggttgtggccgcttacggcaataagctcaccgccgatggccagcccgaattcttcgagcaagacatccccacccatggcaagctgactgatcaggagcactacgagccccggatatacttctcacccaacgcgcccgaatactcaatcgtcggctcgcctaacggcagcaggaccaagggttgggagttcgattatccgacgggttccaacggcgccacgaacaccttcaccggcaacggcggcccctcggtgggcaatttcatgacccgtttgctctactcgatccgcttcggctccgaccagattctcttctccgaccgggtgaccccctcctcgcaaatcctgtacgaccgcagtcccaaggagcgcgtggccaaggtggctccctacctgaccctggacgggcgcgtctacccggctgtggtcggcgggcgggtcaagtggatcgtggacggctacaccacctccgacatgtacccatactcgcaaaaggtggacctgggccccatcacccaggacaccacgaccctgagctcccaggctgtcaagggcctgggctcccagaacgccaactacatacgcaattcggtcaaggccaccgtcgacgcctacgacgggtcggtggacttgtacgcatgggatgccaaagacccggtcctgaaggcctggcagaaaatcttccccagtcaatacaagcccttgaacgagatttcaggcgacctgatgagccacatgcgctacccggagagtctgttcaaggtccagcgccagcttctctcccagtaccatgtaaaccaggccagccagtacttctccggcgaggacttctggcagacccctgtggacccgactgggacggatgacgaacaaaggaacggcgtcaagcagccgccctactacctgaccatgcagacccccggtacctcatcgcccaccttctccctgacctccacctacattcctgccggcacatccacgagggagattctgaccggtttcctgtcggtggactcggacgcaggtcggcagcgggggcggatcggccctgattacgggaccttgcgcctcctggagctgcccaagaactcgaatgttccaggcccgggccaggcccagaacaacttcaactcggacgcggcgatttccaccgagctgaacctcctgcaatcaggctcgaccaaggttaagcgcggcaacctgctgaccttgccggtgggcaacggcctcatctacatccagccggtttatgtgcagtcctcgggcgccacctcgttccccttgctcaagcgggtgctggtggccttcggagataaggtcagctcggcggcgaccctggacgcggctttggataagaccttcaaaggcaactccggcgcctcggccggcgacgcggccaatgccggcaaggacgacagccagtccagtcccgacggcggcaccggtcagaaccaggagcaaccaggccagcaatcccagcagcctcagcagggttcgcccaagcagggcgctggtggctcccaggcgctccagcaatccctgtcggacgccgaccaagcgatgaaggactccgacgccgccctgaagaacggcgacttcagcgcctatggcgaagcccagaaccggctcaaggaggccctgaacaaggctttggaagctgagaagcagggatgaagccggccggcgcaggtcaggcaagctgtgtacaatgctcaaggttcgcagtacctcgaacggaagtgagcgcgcatggcttcgcaattctggctggtcgccggcctgggtaatccaggctccaaatacaaggggacccgtcacaacatgggcttcatgtgcgccgatgtgctggccgagcgctggtccgtcccctttactgaccacaagggtttggcccaactgggcaaaggggtcatgcgcttggacgggcaggcggtgaagttcttcctggccaagccgctgaccttcatgaacgattcgggcgacgcagtttcctcgatcgcctcctactacgacatagtcccagagcggatagtcgtcattcacgacgacatggacttggacttcggccgcatcaaggtcaaagccggcggttcagccggcggtcataacggcattcgttccatcgaccggtccctggggaccaacgcctatgcgcgcgtgcgtcttggcgtcggccacgcccagcgggggcccggagcccacgaacgcacggtcgactgggtcctggggcgattctccccggcgcagcgcagccttttggatgacttcctggctgatggggctgatgcggtggagacggtcatggcccagggcgtggcccaggctcaggagcgcttcaatggccgatgatcgctcccagcggttggatggctccctggcccccctattggaggtcttgcgtgccgaccccgcattcgaccatctggctggcggccggattgaaaccggagaggagcgccccgatgggagcatcgtcctccaggcgccgtcggggattcgtccagccctggcggctgcggcagcggggtcttccaccgtcatcgtcgtcgtgccttccggccgagacgctgaagaaatggcatccgccctgcgctcctggtacccgggtgacgctcgtgatatcgcgctcctgcaggcttgggagaccttgccccacgaaaggctctcccctcgggccgatacggtggccggccgcatggccgtcttccgccgcctggcccacccccaggaggatgacgagcttttcggccatatccgcatcctagtcatgccagtgcgctccctgatccaaccggtggttcagggcctgggcgaggtggaacccctggtcttccgaacggagcgtgatttgcccctggatgaagccgccagccgtctccagcgcgccgcctacacgcgggcggacctggtcatgaaccgcggcgagtacgcggtgcgcggcggcatccttgacgttttcgtccccaccgccgctcatccggcgcgcatcgagtactttggcgatacggtcgattcaattcattccttccacgcctccgaccagcgcacctacggggacgacctggggcaggtctgggccaccccctgccgggagctggagttgaccgaccaagtccgtcagcgcgccgcgtccctcaaggggcgcatccccaacgcggacgacatgctggaatccatcgccgagggcatcccggtggagggtatggaatccctgctgccggccctggtggaccagctggccacggtcgaatcactcctgccacgccgggccgtcgttttcctgtccgaccctgagctcctgcgccgatcggcccaagacctggctaagaccgccaacgagttcctggccgcctcctggcacgtggccgcctccggccatggcgccggcgctccgatctgcttcgaccaggcttccttcatcgactacgacgaggcggtcgcttccttgggctctggtgcgcggcagctcatcgccctcaccgacttcaacgccgactcggtcgtgggtgagggcgaatccctgtccgcgcaggcgccgcaggagttccgcggtgatgaggacaaggctcgttcaggcatcgagggcctgttgaagaccggcgatcgtgtggtggtcaccgccgccgggcaagggaccttgagccgcctgaagcgggcggtcgaggcgaccggtgccgccggcgtggactatgtgcgctcccttgccacggacggtttcgtcgatggcgcagcccacctggccctgctgaccgagcgggatttgaccggtcgttcctcggtggtcgcgccccctaagtcagccaagcgtcgaggcaaggccattgacttgaccgagctcaagcccggcgactatgtggtccatgaagcccacggcatcggtcgcttcctgggtatgcgccagcggcaggtagggctcaaagcaagcaagggcacccgcgagtacctggtcctggagtacgcgccatccaagcgcggcggccctgctgacaagcttttcgtgccagccgaccagctggaccaggtcagcaagtatataggctcggaggcccccaagctcaacaagctcggcggttcggactgggcgcagaccaaggccaaggccaagaagcatgtccacgagatcgccgatgacctggtcaagctctattcggcccgccagcggacccatggttttgccttcagtccagacaccccctggcagaaggagctggaggacgccttcccctaccaggagaccccggaccagctgaccgccatcgatgaggtcaagcgggacatggagcggccagtgcctatggaccggctgatttgcggggatgtaggcttcggtaagaccgagatcgcgatacgggccgcgttcaaagccgttcaggacgccaagcaggtggttgtgctggtgcccaccactctgctggtccagcagcactatcagaccttcaccgagcgcttcgagggcttcccggtcaccgtggcgcagatgagccgcttccagagcccgaaagagaacaaggaggctatggcgggcctggctgacggcactgtggacgtggtgatcggcacccacaagctcctgaatccgaagatccgcttcaaggaccttgggctgatgatcatcgacgaggagcagcgtttcggcgtcgaagacaaggagaccttgaaggccatccgcacgaacgtggacgtgctctcactgtcagccacgccgattcccaggactttggaaatggcggtgaccggcatccgggagatgtccaccctggtcacaccgcccgaggaccgtctgccggtcctgacctacgtgggcgcctacgaggacgcgcaggtgacggccgcgatccggcgcgaactcctacgcggaggccaggtcttctacgtccataaccgtgtggaggacatcgcgaaggtctcggccaaggtccatgagttagtgcccgaggcccgggtggccgtggcccacggcaaaatgggggagaagcagctggacgcggtcatccgggacttctggcgccgggacgtggacgtgctggtatgcacgacgatcgttgagaccggtctggacatccctaatgcgaacacgcttctggtggaccgggcggaccgtttcggcttgagtcagctccaccagctgcgcgggcgcgtggggcgcgggcgggagcgcgcttacgcctacttcctgtatgatccggccaagccgatgacacaggccgctcacgaccgcctgaccacgatcgctcagaacacggccctgggatcgggctacgacgtggccatgaaggacctggagctgcgcggcacgggcaacctgctgggttcagagcagtccggccacatcgagggcgtgggcttcgacctgtatgtgcgcatggtctcccaggccgtcgatgagtataaggagcctgaacgtgcagaaccggtctcggtctcgatcgatctgccgctggaggcttcgatacccactgactacatcgactcggacaaactgcggctggaggcataccgtaagctggcttccgcccaggacgagcaggatttgcaagacctgtatgaggagttgagcgaccgttacggccccccgcccaccgagttcgagaccctgttcgcggtggcccgcttgcgctccaaggcccgggccctgggcatcagtgagatcaacggtcagtcctcgcgtgtgcgcgtcagcaagcttgacatgcccgaatcccttcagatgcgcatctcccgtctctacaagggctcgcgctaccatgcggtcacacatgtcctccaagtacccgctccgttcgctggcggcctgggcgctaaacccatggattcggagcagatcttggagtggaccgaccgcctcctcgatgacttggcctataagcatgagcctaaaacgcaagcgtcagaagcattgtgagcgctcacacgttttccttgcccctcgtccatcaaaggcactaacctggaagtgtcaacacaacagagttgtaaccataaaggagcagttgtggcagcaattgaaagcgtgtacgcacgcgagattcttgattcccgtggcaacccgaccgtcgaggtgattcttgagaccgaagacggcgcggaaggccgtggcctggtcccctccggcgcttcgaccggcgaggccgaggcttgggagcgtcgcgacggcgacaagaagcgttaccagggcaagggcgtcctggacgcggtcaaggccgtcaatgagaccatcgccccgaacgtcattggcatggatgcttccgaccagcgcgcgctggacgagaccatgatcgccctcgacggcacccccaacaagggcaagctgggcgccaacgccatcctgggcgtctccctggccgctatgtacgcggccgccgagtccgccgaactgccgctctaccgctacctcggcggcaccaacggccacatcctcccggtgccgaacatgaacatcatgaacggcggcgcccacgccgacttcgccacggacatccaggagtacatgatctccccctacggcttcgactcgtaccgtgaggccctgcgcgcaggcgtcgaggtgtaccacaccctcaagggcatcctgaagaaggatggccacgagaccggactgggcgacgagggcggcttcgctcccaagatgaagtccaacgaggactctttgaagtacatcatggacgccatctccgccgccggttacgagcccggcaagcagattggcctgtgcctggatgtggcttcctccgagttctacagcaaggacaaggacaagtaccacttcgacggcgaggaccgcgacgccgactacatgctggactactaccagggcttggtggagaagtacccgctggtctccatcgaggatcccttcgctgaggaggactgggctgcctggcagaagatcaccgcggccatgggcgaccgcctgcagttcgtcggcgatgacctgctggtgaccaaccccaagcgcctacagaagggcatcgacttgaaggccgccaacagcctcctggtcaagctcaaccagattggcaccgtcaccgagaccctcgacgcgattgagctggccaccgccaacggcttcacctcgatggtctcccaccgttccggcgagacttccgacaccacgatcgccgatctggccgtggcgaagaacacccgccagatcaagaccggtgctccggcccgtggtgagcgcatcgccaagtacaaccgtctgcttgagatcgaggaggagctgggctccaccgctgagtacgcgggttactccgccttcaaggcctgcaagcagtacatgaagtaagccttccgagaccggtgcctcacggtgatggtgttggggcaccggtcgtgttcgcccgtggctcgccgagtcggctgccacgggtatttttgtgggtatgaccaaagcaagccttccgcgttcacagcgggcatcagcgggcgtcagcggttctcaagaccgtaaaggcggcaagcgggggagaagcccagtctccctgtgcatcagtctgatcatcgtcttcatcggtgccatccagctggtctccactttccacacctatgcggtgaacctctccgagcttaacggtctgaagaaccagcaggcgaccctggttgcgcagaagagccagttggagaacgacatagcccgatggaacgaccaggcttacgtcaccgcgcaggccagggatcggctggggttcgttttccccggcgagcaggcgatacgggtgctcaacccggaatccgtcataggggggaaggtgcccagcgccaagagcaagagcacgagcccctcggacaaaggccaggtcaggccccccctgccctggtaccgtgagatggcttattctctaggcaaggccgacgcatcggcccaggccaagactcaaacccagtcccagtcggatagcggcggccaggggcggaccagtccggggggagccagcgatagcggccgggaggaccagcgttgagcgcgaatacgggggcgagcgaaaacacatcgattgatggggtcgaggtcatggccctgagcgtcgaggcgattgaagacttggtcggtcgggctttgagccaccgggccagcccagagcaaatcgagcgcgtggaaaaggagctgggtcgctacccgcggggcattgtggccgtgggcgccagctgcgtctgcggcaacccgctggcagtgattaccaggcccctgctgccgggtggcatcccatttccgaccacctgctatctgaccgcccctgaggcggtcaaagctgtctcgcagcttgaggccgagggcaggatggccgcttggaacgaggccttggcccaagacgaggacctgcgcgttggatacgggcgtgcccaccgcacctacttggccttccgccgggccctggcacaaggcttgggcgacgatgagagccatatcgaaggtgtttcggccggtgggatgcccagtcgggtcaagtgcctgcatgccttggtcgcccagtccctggtcatgggggagggggtcaaccctgtgggcgatcaaacgctggcggaggtcaaggggctcttcgatcccgtcgtctgtcgttgtgagcgtccctggggatgcgcggaagggcagggcgccggtccagaggggcggtagaccgcctggcttggacagactggaccacaaggtaaaagtgttgcggggccggcgttagctggctacgaggaagggagcgcgccaggcatggatgcggtgacagtggctggagtggactgcgggaccaattcgatccggctcatgctggctcaggtggatgaggcgggcctgcacccgctgctgccgagaaccatgcgggtgattcgcttgggcgagggcgtggacgagcaccgccggttctcccaggaggctctggaacgcgcttgggtcgcagccagggagttcgcgcggattctcgcaggtcatcagatggatgccatgcgtttcgtcgccacctccgcgagtcgggacgctgagaaccggtcggaattcgaggacggcatccaagacatcctgggggtcaggccggaggtgatcgctgggtccgaggaggccaggctgagtttcctgggcgcggtgagcgtgttggaggcccgtcggcagccagctgacatgtccccggccccgtatttggtcgtcgacctgggcggcggctcgaccgagctggtggttggcggcgatggtggtcaggcgccggccgaccaggcccaggcctcctactcgatgaacatcggttcggtgcgcatgaccgagcgccacttgaaatccgacccagccgctgctggacagatccgcgcagcccaggcggatgtggacgcccacatcgaccaggccttcaagcaagtgccggtgggaggggtacgcaccttgatcggggtctcaggaactgttaccactatggccgccctggccttgggcctcaaaacctacgacagccaaatcgtggacggggctcaggtgcgcatggccgacattcaggaggcgggccgccgggtcctggccatgagccgaagccagcgggctgagctcaaagccatccaccctgggcgcgtcgatgtgatcggcggcggggccctgatcctgaatcagctcttggaccgtctgcgtcaggaggcgcctgacctgggcacgggcttcgtcgcctccgagcatgggctcctggatgggatggtcttggacctgggccgacggctgttggctgaacgggcgcgttcctgttcggcctgaagggtatagtggccaaggtgaggcgagccccggtggcgaaacggtagacgcagcggacttaaaatccgccgccctcgcgggtgtgtgggttcgattcccacccggggcacgagcggggtcctagcgggtccatgacttgtaacttacacttagagccgataccctagggtgagctcactagttcggaggacagacatgacagcagaaggcatgccgcgggttaacgcagatttcggtgcgtacccgacggtcgaattcgagggcgaagcccccgcaggcctgaaagtcgtggagcttgtggaaggggacgggccgctcgttcgtaagggcgatacggtcaccgtcaactaccacggcctggtatggggttcggactcgccgttcgactcctctttcgaccgtcatcagcccgcctccttcgccattggcgtgggtcaggtgattaaaggctgggatcagagcctgcccggtcacaatgtgggctcccggatcttggtctcgattccttcccagtacggctatgggccgcagggtatgccccaggccggcatcggtgggggagacacgctcgtcttcgtgatcgacatcatatcgacccgttgacgctccgaccgtcaagcgccggtcagggccggcgctttttcttatatgcgcccggcttgtgcacagccgcacctgccgagcgtccagcgccagcggcactcgatgaagcataggccaagaagggaaatcaagatctacagcgttcgcgcctatggcgcgggcgccggagctccgcagggggaggcgctcacaaaaccgtgaatagtaaaggagaataagatggctgaggaagagacgatcctgctcacccaggaagcgtacgacaagctccaagatgagctcaaacaccggcagggggagtaccgcgatgagatcaccgagcgcatcgccgccgcgcgggctgaaggcgatttgagcgaaaatggaggttaccaggccgcccgtgaggagcaaggcaagaacgaggggcgcatcaacgagctgatcgtcaagctgcgcaacgcgaagatcctgaaagcccccaaggcagggatggtcggcaacggttcggttgtcacgctggagctggccgggtccgagcaaatctatgtgctgggctcacgcgacatcgccgtggccaccgactacgacgtgattagcccggaatccccgattggcgcggccatcatgggccataagaagggcgataaggtctcttacaaggcgccgaatggcaaggagatcagcgtggacatcaaggatgcccagccgctcaagtgaggcactgaggttccgcctcccccggctcccttggggccccgcgctggtgccgcctgaccaaggcgtgaggctggctcaggggccccaaggctacctgagctggcatacgacaaggtagatggctaccacatggcaggcgtagccggctacagtgccactgtggaagatctcatggaagccgaagactttgggccaggggtcgggcttgcacagggcgtagacgacggcgccggcgatgtagcacaagccgccggcgataaggagccagacgaccgcagggcctgcggacggcgacttccagaagaggcccaggaaggccacgcccgcaacgccgaaaatcacataaaccgtggtgtagagccagcgtggggcggaaatccagaccacgtggatgaacatgactactatggtggccgaccagatgccaaccaggatgacccgccgccagaaaccgtccagggcgaaggcgaccggcgtgtaggtcccggcgatcaaaaggaagatgttcgcatggtccaagcgtcgcaggatgtcggtgacccttggtgaccaatcgcccaggtggtaaagggcggaattgccgaacagggccagcgagcagagcatgaagaccacgcaagcccacttgatcccaacaccgggcgcgatacaaatcaagacgatgcccgaggccagagctagtggactggcggctgcatgaatccagccgcgcatcaagggcttagggcgaccgtgcacgtccagccggaccttacgtgcgattccccgtgcaggtatgccttcgattttggcggccttgaggtcgcccgcctggatgatccgtgaggctcggtcccgagctttgtccctcgccgcatccgcattggctttcatacggtccccccgggccagatgggcttgctggcgggcatcgggaagccccaaccggcgctgctcacgctgggccgcaacccgttgaccgccctgctcctggggatgattcgccatcgcgctccttcaaccatggcgcacggcccctgagcccacgcgcccgtctccctctccaccagtctatcccggaccccgttcagcgggttcagaccttggcgcggctggctcacctgacggcgagagggtctggcaggccggacccctttcgctatgatgaaggtatggctgatttctccgagattctctccacgtttcaggacttcgacgaagccgaccgtgagtggcttcatttgctggtggccgactggcaggtgatcgccgacctgagctttgcggacctgctgctcctcctgcggcgcaaggatgggcgctatgtagtcgctgagcagtgccgaccctccacggtcatgtccctgctcaccgaggatgtcgtaggcgacttgctgcccgaggaccgcacagcggagttggacacggccatgaactcgaagaaagtcctgcgttccaacaagatgcgcacgattggcaaagttacggtctgcgacgtttacgcccccatccgccaccaagggaagaccctggggctggtggccagggagacgaacatggccacccgcgaatcaaacggccgctacgagggggagagcatcaacgccggcaaggccttgttcgatatggttacccgggggcggttcccctactcggactcggtcttgaaccagcgccataacgcgcgcgtagccgacggcttcatcatcctgaccgccgatgggattgtgcgctacgcctcgcccaacgccatctcctgcttccgccgcctcggatcggtcgagaccatgcccggtcagtacctgagcgagatcggcacttcgctgattcaacagaacgaccccctgcctgagtcactgccattggtgctgaccggcaaggcggccgtcgattctgaactagtggtcaaccgttccgccgtctccatgcgctccctgcccttgtatggcaaggaagggcgtgtgggaggcatcgtcctgtgcagggatgtgaccgagttaagaaggcgggagaaggaattgcagaccaaggacgccacaatctccgaaatccaccaccgggtcaagaacaacctgcaaacagtctccgcccttttacggctccagagccggcggaccaagtccgaggaggtgcgcaaggagctggaggaagcccagcggcgggtgcagaccatagcggttgtgcacgaggggctgagccagaccgccgacgagatcgtcgacttcgacaaggtgatagccaacctgctgaagctcagcgtggacctggcgaccacctccgaccagaaaatcgccatatcctacatcggcaagtttggcatgatgccggcccaggacgccacgcccctgtcgctggtgctgaccgagctggtcaacaatgcggtcgagcacggtttcgagggccgcaagagcggtcacatcacgatttccgtaggtcgcggaggcgataacctgaatgtcgtggtcgaggatgacggcaatggctacgacacggaatccaaggctgggttggcccgcccatccggttcgggacttggcacgcaaatcattaacacgttcgtgactaacgacttcggtggcacggtgcgctgggggcctcgccgcgatggcggcacccgcgtggtgattaacatcaagctgcgcgtggcccagaagactggcgacaagagcctctgagcgcggtcgattgctgcgacggaccaagacatacgaaatggagggacttggcgatgctctatcgccaagcccctccataaggttgcttacaagcggtcacaggctgtaaggcgaagcttccagcctcatgcctgcgccaagctcaggactgctgcatggcctgggttcggcgggcgcgcatggcccggcgcttcaaggcccgccgctcatcctcgctcaaaccgccccagaccccgtaatcctggttggtgtccagagcgcacttcaggcaagcgtcgatgacctcgcaggtccggcagacggccttggcctcttcaatctgctggtaggcggcgcccgtgtttcccaccgggaagaagagctccggatccttgtcacggcatgccgctttggcccgccaatcaaatgcgctgctcatgcttgatgtaccccttgccttccatactttggaactcgaacttcttatagggaagcacgattacgccgacttttcaaggttttggcggcgatttcccacagggcatgcattggagggccctggcctggccccgtccgaccaggaccgctcggcccggtgtggcggacgccttggagcccagacgcgccaggagggaggttgggatgcctgccatcagatccgttccacggtcgccgctggggaaaaggatacgcaccgggaaaagctcgggcttgcgcagggggcggggcgactccaggctcagcaacacgtcaacgcgagagtcctccagcgctgcttgcaggcggcgggccaggggctcctggttcaaggggtccatgagtttgtcggctccgtcaatcagccagagggcgtgcggtgcgcgtgggggctggcacctgtctgcctgtcgttgttgcccatttgcgcgcatgactggccccgacccgggcacctggcagggacttgcccacgattctggagcggatgggttcgctctgattcgtcggctgacgaagccctgagacctcggctgggtccaggtcagttgaaggggcccccgtcccaggtcgtggccagccagggcttcaagttgggagaggatggttttcaagcaggtggtcttcccccggcctgccccaccgataacggcaatgttcccctcgatcgggagcagacagggagaggtcatcaccccatcgtcggtcaagccaatcggcaggagtgggcagcggtccctgacacgcgggccatacttgccccttgcgtgcgccggcagctgctgaggcaggggggtggtgaaaagggctttcgctgggttaaggccagcgaaagcggcggccaagcgcacatgatcaaccaccaggcccacatccgcgcacggcgagcagcggaagggttccaaccgatcgccatcgctccagaaaccggcccccggcaggttggggctgattctcgccgcgcaatccgccccaagcagctccttggattgaaggggttcacgcacccgcaggctgatgttcaggttcatgttcgacttcatatgggcgctcacctggcccatcgggttttgcgtgcaggcgatcaggttcatgcccagggagcgccccagggaggccagctggaccaggtggtccatataattcggcagctgctggcgcaaggcctggaactcgtcgatgaccacaaccaggcggggtggcggttggcgtaggtcgctggctccagtgcccccttcggctgcaatcaggtgctcgcggcgcttgagttcgcgttcgatgccctcgatggcccggaccgcgtggtccaggtccaggtcggagaccgaacccgctgtgtggggtagtcggctcagctggttgaaggcggagccacctttgaaatccaagaagacgaaattgagttggttgggcggcagggcgcaggctaaggacaggcaccaggcctgtaggaagacggacttgcctgatccggtcgtaccggccacaagggcgtgcgggccctgcttgggcagattcaggcggaagtcgccgtcggggcagacgccgatgaccgcctcgcagagcgactcggtcaggtccgtgcgttcccctgcgaggagccagcggcggacgaccccctgccagagggctccgccagagtcccgcgcctcatgtcctggcaggatgcgctccaagcggggaggggagagggtttcgaagcagggattgaggtcgtttgtgattcccgctgaccaaggttcattggaagagaccgtcctgtgggccgaccgaggggattgacgctcctgtcgttcacccaagtaggtggataagcccgccgccaggctggctaggaggctgggggcgaaaagggccgcgtacatccagcgcccctgggctcccatcagcgcgacgagtgccacctgggccaggattggcgccacttggccagccaaacgcagtttggaaatcgcggcttggcatttatctgggccgtcgttcgcgcgtgggcgccgcgtgtgggggaatccgctcatgggtcatgagtctgctccctagtggcctaacaggtccagtctgtcagacgcatgtggtcgaatgtgcctgacgcccgcttacatgccgccaacggtgccgggttggtgggtgcctttgttgagacggtcgaagaggtccaggttgcgtttgtcatccagcagcacggtggagccaagaccgcctggatagtagtcagggtctgtccaatagaccgagccgttgatcccatcggccccggatgcgtcacggaaggccaggagcatgcgcgccaaggtcagggggttagcgttctcatccacgatgacagcgcctagggccgccttggctagcttggagtcggtggagggattgctcagggtcttcggcgaagccgctttctgggcgatggcgccaatcaccttccgttgacgctcggcccggccgaaatctcccttggaatccgcgtagcgcatgcgggagaaggccaaagcggtcccgccgtcaacgtcgtggcatcccgcggtccaattgagcccggaatacggatcgttgacgctctggtcatagcacaggttgacgccgccaatggcgttgacgacgccttccaagcctccgaagcgaatcagagcggcatggtcgattttgtggccggtgatgacttcgacctgcccggtcagtgctgggtagccctgcaggttagcgacagcgttgattttcatatcctcgtctcccgccttcaccaacgagtcacgggggattgagatcagtgaagcgggaccgtgcttcggcttggtcagcaccagaatcgtgtcggtgcggaatcccggagtatcgtctgagctgccagtgccttgagtgccgtcgcgctcgtccgagccaaggatgagccaggatgtggccggccccgaagccatctgtgtgagcatgtttttatgctggagctgccggtccacccacatccaggtgtagccgcagccagcagccgtgagccccaggatcaggaccagaaggatggctatggtcttgcgcacgcgatgacggccgggcttgcccgctgttgcggtgaacgccgcaggtctcgtggctggagcgactgaagtcagcgggcggggcatggatgcgttggctccgccggccatgcgggaggagccagatgagcgccttgccgagcgagggggggtcggattggccgcacgaggcccgtcgctggaataggctacgggcagggaggacttcccgcgcccaatgctctgactggtcctgggggtggctggagcggcgcccgaacgagctgtgcccccgctccgacggggttcgcgcgcctggctggcttgcttggtctgctggggttgtctggcttgcacgtgctggcggcgaaattgctgggagctaccggcgggaaggaaggaggggggttcctgtgccgacgattgacgttgttctctctcgctcatcaggatccatcccctagtctcgcccccggtctcttcagacttagacttaacatgccgctagaattcaccgaggatttcccgctcacttctgcgcaggaacggcacatacggtggcggacaggtagcggtcggcgatgccgatgtactggccgctgcccgcatcccggatcgttccatcttcggaatctacgattcccccagttactgggtcgatcagctggccgccgcgggtgattaaacctgttttggggtcgggggtctcttgttggtttgccgaagccgagggggacgttccctgggcgccctgggtctgcgtctgagcctggggccgctgtccctgttcgcgttgggatggtgcctgtttgccagcggcatccagattctgctgcctgacctggttgagctcggcatcggtcaggggtttctccgctcggagtgcggcccatacggtcttggcgtcgctggaccaacgcacccgggcttgggggtagtcgggatcgggttcgacaggcagggtccttgagtagacatgcgaggcgtcgatgtgttgcatgctgtccgccagaccgtacagggtcatcacattgcccaggccctggctgaactgcaaggccgacagggaggtcttagatagttggaacattttgccgaagttggagtagacatcgctgctcttggcctcgttcatcagcgacttgatcaggtactgctggcgggtggtgcgcatgatgtcggagccgtccgtgccggtgccgtgacgcatacgcgcgtactgggtggcttgggtgccatccaagtgttgcagtccgcgcttgatgtcgacgccggtgtagccgtcccaagtgtcttgcggcacgcagatattgacaccgcccagggcgtcgatcacgtccttgagtccgttgaaatcagcgacgacgaactgttggacgtccagaccggtcagggtgttgaccgccgtcagcgcgcaagaggcggccgaggccacgtcgccaccctgctggtagccggtggcgaagattgaattgaacatcacgtagtgccgggcgggaatggtcttcccggagctcgtcgtgcaagctggggcgttgaccattgagtcgcgggggatgggcaccaggttaatgtaggagcggtcagcggcgatttgcgcaacgatggctgtgtccgactggtggttctcggcgtcttcggggtcatcgccgccgatggcggcgtttccggcgcctgagcgtgtgtcctggccgaggacgagtacgttcagggtcttacccttgtaaatgtcctcgggctttggggtcttggcaccggccttgagctggtggaccgaggggacgacgttgacgctgccgaggatctcgatcgcggcagcggcgacgaaggcggctacgaaagcgatggcggcgcacgcgctgatggctacggccttgcgggcccggtgggagattcggaatccaagcgagtgtttggggcccgaacgagcccgcccacggatgttgggcaggtcgtggttgctctccttgtgtgaggtcacgttcgcgccttcctgctctgcgctgctggttccatgctcgccgcgcgcttgggcagacgggtcctacgagctgtcgtgcgcgcatactcccgccaattgtaagacttgggctggcctggaaggcccggccaagagctccagaggccgactgccggcgtgcgtggacggggtcccgggcccgccgctgggcgggaaggcgctctgctgacttggcttgggcctgcgggcggagcgaatgtgaaaaatgtgcaagaactgccggactcagggcctcatacaaggccttgcgtagactggagcctatgacttcgtccactcctgtgttctccgacgtccagcaggtcctcgccagcgtcttggccgaacggccccgctccgtccggcaggaggtggatccgtcggtcgcggctctggtgagcgtggaggccgatatgacctacctgcccgccaccctgtccggcctgttcagccagaggctcatgccttccctggtcatcatcgccgactgctcgggtcgtaccactgagcccttgtactccacgctgacgcttgatcggggccaaggacaggctcccgctcgtacggtgcggattgaagtggtgagggctcacggggccaggtcgtacggtgacgcggtgcgccgtgctttgggctacgctaatcttcccgccagtgtgcgcgctctttggctcttgcatgatgactcccgtcccttggacgaggactgcttggaaaccttggttggcacctggcgtgatacgcccgcggcctccttgctgggcgccaaacaactggactgggagggccggggcctgcacaacgtggggtcctatgcggttaagggagggctgaacagcctggttgtggacggcgaacccgaccaggagcagtacgacgcccggcaggatgtcttcgcggtcagcctggccggcgccctggtgcccttgcagaccctatcatccctctcgggtttgggctcctgggccagcaccttcggcttatccgctgacttctgccggagggcctgcctgtccgggggccgggtggtggtggccccggccgcgcggatcgctcatcgtcgggcccgctacgagggtttgcgcggcaaggatggcgagcaaagcgagcaggagaacccgcgcgacagctccatgcaggtcatcgatgcccgcgaatcatacttgtactcggggcatcggcctctgacctggcctgtgctctggatcgcccgtcttctggccgctttctggttcgctgcgctcagcctgaccgcccaacggccctatgcggcggtctgcgagctctgcgccccctggcgtgtgctgggccacttgggccatctcttctcggcccgccttcacttgtcccgggtcgtcaacacatcgttcaagcatttggaaccacttcaggcctcccacgcgcaggtcaaacagtggagggcacgcaccagggcttatgaggaccagttggcccgtcctctgctcagcaacctggctcgtgcgcacttacgcaggcttcagcgaatccgtgtcctctgggccctgggcatggttgtcgttgtgatggtttacacggcttgggccgcttggcctgtcctcaaatcccttttccaaggaggtgccctgacctccgactacttgctgagctcgtcggcagggttggggcagctggctcgcgcggcgaccgtgccgtggacctggggtttggccctgggcgcacccagcccgcccacgcctttccttctcctgctgctgccgctggccgttctgaccggcggtcgggtctgggtggccgtggccttcctcttcttcgcttgcctgcctttggcggccctgtctttctgggctttggctggtgtcttcacccgatccaacccgattcgggccatctccggtctgctttgggccgctttggctttcgccctgcccctttacgccgacggtgacctgccaggcctggtcgttctggctttcctgcccgcggccttcgctttcaccttccgggctgtgggcatgtaccacaccgagcagccggctcaaccacacccctccgccaggagcgcggcttgcgcctccctgtgcttcatggctgttgtgctggccgaacctcagctcctgctggccttggtggtcgtcttcatcctcttcgtctgcctggtggttagccacaggaccatgctggtcatgatccccctccctgcggccctggctatggcgccaaccctggtcaacgcggtagggcactggggccagggaggctggcggcagttgttcggcgatgtgacccaagcctcctcatcccgcttcgggcatcccagggcagcgagcgtggtggacctggtcacaggcttgctgcgggtggatgtctctggcggaccatcgacttggttggctcgtaattcatggcaatccttggcctttctcggcgtcttggccctcgttgcagcaatcgccctggtcagtctttgcctgtcctcgatttcccgtgtctcccggctcatgtggttcctgtccatcgtgggcgcggccctggctacggtttccgcctgcgtggcggtggggcaggattggtccgggccagtcgctgggtcgcccttgcctggtctgatgctcgctcttctaggtctgctggcctgtgttgcgatgattgctgggggcgcggtcacgccgttcaccgcgatgaatgtacgctggagtaacggttaccatgcctatacggctttggggtcagccaccgacgcttccgagttggaggctgaggccaacggcgacgtctcccagtcagcgtccgccgtcagcttccatggtctgatcagacggttactgggccgctggtccctcacacgagtagccagggccgtccttgccgtcgtcctcctggccatcctggctttctgtggcgctgtggggctgcatagcgcatctgtctcgtcccttgcagccaggcagggaggtttgccgatggtggcggtggattacctgagccgttccgagtctcaccgggtcctcgccctggcgccggtcaacgagcgccaagtgggctttgtctccatgcgcacggccaggggcgatatggtggactcttcggctgccgcccaatccatgcccctgagcggtcggcaggaccaagctgaccggagactctcctcggctgccgccgccttgatggccagcgcggattcccaggcgattgagacgatcagtcagctgggcttcggaggcatcttcgtgccgtccgggcaggctgaggaagctatgggcggttcggcttcacccgccgagaccttgacggctaacatcaccggggctgacggaacccagcaagtggtcaccgggccttcaggcacttacttccgcctgacccgcgtcgacgccagtcatcagggggtccacctggagggtgagcgagctgctgccggcttgtggtggcggccggtctggctttggtcgttgggcttggtccttctggcctactgcttggtcgccctgcctcgatggaccctgagcgaagggagcgcagcatgagcacgaacgcatcgccgcagtcggcccagcaggacagcaaggcccaggacgtcccaaaggctcaagtcccgcaagggcggcggatggggagagtcgtaacctccgctttgacggctctgatcatcatcgccttggccctggctctcctgctgctgaggcccccgagcgcgctgagtgaccaggggcgggtcgcggacatcggttccagacaggtcagtcagctgaacttgacggattactgccccgcccgtatgagtttggcggacaccactggtttcggcgaagctaagccggatgaaggcaacatcgcctcggcttcccggtatgcggcttttggtcctgtctatgcctcctacgcgcgcacagtgggatccgacgacgagctcaagctgaacgacgccgaccccagtgacgacgaccaggttcagacggcctcaagcccagccggcgaaggaggcagcatccaatccacgcgcttgctcaaagccgttcagggggccggcgccgcgtcgtcgatggtctcttgggctacttccggtgatctcaggggtgtgcaggcggcttcttgcctgcccacaggcttcgagcgctccttcttgctgccagccagtcagaagggatggtcgcagcagctggttgtgtacaacccctcgactaaggccgccagcgtgaacttggaagcgtatgggaccagcgcgcgcggacccctggccttgaacacgcgcggagtggttaccgtcaaggctggtggggattctgtgtacgatttggcggcggccgcgccgggtcaggacgcgcttttcgtgcgtttgaccggcaccgacgccccggtcgccgccacggttcggctgagcgccatgtccggcaccgacgctctgggctcggatttcgccacagacatcggccaggagtcgcgtcaggccgtcctgccgggggtggagggcggcgatcagccccagcttctgttgatgagccagggcaaggcccatatcaaggcttcctgggtcttaagcactggctccacccaagctaaggaagccgatctgcctggcggacgagtggccgcgattgacatgggccaggcacccgaaggcgcggtgggcttgagtctggatgcggatgcgccagtgcttagcgccgctaagctgaccaggcaggggcaggatggccaatccgacttcgccatgttggcacccgccagtgcccggaaggtcagcgccatagccttgcctgatcaagcggtcggcagtctggcgctggtcaatgtcagcggccgcgagtcctcggccacgctcgtaggtctcgacggcgctggcaagcgaaccggctcgcggagcctgaacttgaaccctgggcagggaaccatcgtcagcatggcggacctggggcatggcaccgctcttgcgcgcttggaggattcgaacgccaccttggcctggtcggctcgtgtaggggtggacgcggtctcccaggctggggtgacgggcttggctgtggtcggggcgcaggctttggagccgcagaccctgcgtgtgcgcgcccagcaggacaggaccttagtcaggtaggggggctgaatcggccggcccggcttaggccccccaagaggggtcgatgtcctccgggtggcggccgtagagttccgacaggcgcaggaccatttcgtcgcgaatcatcagttccagctcgtagcggctgtgggccttggtctgcatgggcaggcggtagaggactattctggcatcgacgccatggctgggagcgaatgaccgggataaggcgcagggctcgttgtcccagggcagggggtccgaaggcggcacatcttcgacagcgaactggaccggccccaccagctgcggccaggccatgcccaggcgtttgatttgtgaggcgaccatcgtgtcgaaaaggcccgcgttggtgcgggaacgggggagccgggagccgaaagtgggtcgacgcacaccccggccgtgcaggtcacggtaggagccctgcgtccagggtgttcgggcggaattcatgggaccaccatagcccttccgcctgatatggaggccttgctaggatactgcttgtccagcggcgcggggtcgctgccagcttcaaggggtaaggagtcgctcatgggcttgggccagcgctcaccaatcgtcgtgcggccttggcgccagcaggacttgtccgccatctgcgccagggcacaggttctggctttcgacctggacaccactttggcccgttccaagaccaggatggacccggacatggccgtccgcttcgccgccatgaccaacctgcgcccaacggccatcgtgtcgggcgggcgcttcgagcaattccgggaccaggtcttggatgctttgccggccgccgccgatctgagcgccctccatctgatgcccacttccggcacccgctactaccgatggggcggctcgggctggcagcaggtttatgcccatgatttgagcgctcaggagcgggaggcagccgtgaacagcctggagcgcagggcccgccagctgggcgactgggaggagcggacctgggggcctcgcatcgaggaccgcggtagccagatcactttctccgccttgggccaggaggcgccggtggacgctaaggaggcttgggacccgaccaatgagcgcaagaacgccttggcccaggccgtggccgctgacctgcccgacctgcaagtgcgctcgggaggctccaccagcgtcgacatttccgccaagggcattgacaaggcttacgccgtgggacagttagcgggaatcctgtcggtgccagtggaccggatggttttcgtgggcgatcggatggatccggacggcaacgattacccggcggcccaggctgggaccatggccctgagagtcaacgatcccgatgacacgcttgagcttttggaggcgatggagccgcttttgcgggcctgacctctacttcgcccctctgacgttcgccggcacattcgaccacatgggtgcgctgtccttgcctatcggcctcctagcctcttatcctggcccgcatggatggaagcgcacatgttccgaggctttgggttccgggcctgttggccgcagtccgtgatttgatcgtgccccgaggttgcgctggttgcgactgcccggacgaggtcttgtgcccggcctgcgccgctctcttccggcagtatcggagtttcccggccgctggcttcgtctgggggagcggcctggcctgtgctggctaccaggggcgggcccggcgggcaatcctggagtggaaggaccatgacgatgaggaggtcaccaggcccttagggcgcgctatgggcgagctggcggtccagtccctggagcgggcctggactgggaacctcggtccggttccctcgcaagtgctgattgtccccgccccctcgtcatccaaatcggtccgcaggcggggacgggtccacatgccgccggtggccggggccgcggctgcctcgctgcgccaagccggtctgccagctcaggttcagttggcgctgattatggggtcggtgcggggtaagtccgtagagctccacgggtcctcggcgcgggcctcccgcctgagcgggcgtattcacacccgggctggcattgagttgactggccagtcagtcatcctggttgatgatatcgtcaccagtggttccaccatccgccagtgcgctgcggcccttcggaccgccggggcttaccccttgacagccctggccctggcgcgggccggtcggggatctgaccccagccgggccgttgagcctgtgcccgtcatctagcgagcgtggacggtcgccatctcgtcccagcgggtggtgcagcggggtgagagcatccgccggttcatggcccactcggctccggtgtcctcatcctgccgtcctttgccgcgcacgcccccgaagccgatgccgacccgaaaagggccgaagcggcgggccgcctcatccagggccggacccagtccccggtcccggttggcttccaagccatccaaggtctggtagcctttagcgtctcgcaggttctccaaaacgacgccagcgcgtatgtaggcggcatgagggtcgactcgtcccgccaaggcggtcctggcggcccgggtgatgaccacggggtcgtccgatggatcctccaggcgcgtctgcccgctcatcgctgagtattggccgggcgcgtaaggactggaggagcagaagacgcgcacccgggagcataggcttccctgccggcgcaggcgggagcaggctttctgcgcgtagacgcccagggcttggctgagggtgccgaagccgaccacaggttttgagaacatgcgcgagcacaggatttgctgggagcgggctccgccattggcatcctcctcgcgttcgatcgccggtgtgccgcgcagctccaggactgtgcgctccaagagcacggagaagcgccgcctcatcgccgttgggtccgcgcgttggaggtccagggcggtcaggatgcccgtggactccagctttttggtcagccgtcggccaaccccccacacatcggccactggcaccgaggccagggcccggtcaccgtcttgggccagcacttgactccacagggtgaccccgttggctccggggtggttcttagcccaatgattggccactttagcaagggtcttggtgggtgccacgcccacgctgaccgggatgccgaccgaccgcaggacggtctcgcgcaagtccgcgcagatggcttgggttcgttggccgtcccagagggagagcatgaaacactcatcgatcgagtagacctcctgctcaggcaggaagttcgccatgatggacatcatccggtgggagagggaggcgtagagctcgtagttggaggagcgggccaccaccccgtcgcgctcggcctgctcgcggatcttgaaccagggggtgccgttggcgatcccgagtcgtttggccgcaggggagcgggccaccacacagccgtcgttgttggacaggacgaccacaggccgaccggccagactgggattgaagacggattcgcaggaagcgaaaaaggagttagcgtcggccagcacgaattgcggggtcaggcgagcgtggtcgtagagttggtcttgattgaagtcttcaggcatggccgccccatccggcactggggtagggggcggatctgcgtgtgccctgtcccgagctcggaccgccgctttggcgcccatgccccgcccgggcggacgagggcgctccggctgtgggcgcgccgggccttgggcagctgacggaaggcgctggattgcggttggcccgtgcaggggtctcctcccgctgccagtggtagttgccggtcactaccccccagacgaccaaaacttcacctccctggggcttgaaatccgggtaggccgggttctccgcctgcagccaggtccgcccaccttcgctgcgcaggcgtttgacggtcaattcgtcatccaggatcgcgatgaccacatccccgtcgcaggggtccagaccccggtccacgaccaggaggtccccatcgaaaatgcccgcgccagtcatcgagtcgcctgccacccgcaccacaaacgtggagtctggatggatgaagacgtgctcgtcgaaagagaattcagtggaaaagtagtcctgagccactgaagggaagcctgcatggaccgcctccagcgctaggggaaccgggtgaggcatccgcgtgacagagtggacgcccctgagcgagacggttcgcgcgccctgctgtgggcgcgcttccatgggagctttaccaggctgttttcccatcgtcatcacctcgcctgagaacatgagaacatttgttcgaatcagtatgctccgacgaatggacaggaatcaggacaggtccaggtccgtcccggcctcctcctgctcaatgtggtatttgggcagggtgacctcgaaatcgaccccgcgcgtgtcgtccaccacgtgaatctgaccgccgtgcagctgggcggcccagcgggctatcgacagtcccagcccggtgcccccggattcggtgccgggaccggtgcgccccttgacgaagcgccggaagatgtcggagcgggcctccagtggaatctgggagccgaagttgaccacattggtcacaaccgtgtcctgggcctggtcctcatgggcctcgatcaggaccgtggtcccgtcggccgaatgcttcaaagcgttggagatgacgttggtgaagagctggcgcaggcggttctgatcgccctccatcgtgatgtcggcgggcatgtcgatgtggatgtcgtgggcgtgcccggcgtcggcgatttccagggggcccactgtgtcgtcgatgaagtcagcgaagttgaacttctcgacctccaggctggcggcgcccgcctccatacgcgagaggtccagcaggaaggcgatgaggtcggacaggcggtgggtttggtccaggatgccttccaggttggccggtgtgggctcggtgaccccatcggccatgttctccaccatcgcctggagggcggagaccggtgtgcgcagctcgtgggagacgttcgctaccatgtcccggcgcatttggtcagcgtgctgaagctcctcggccatctcattgaaggaacgggtcaggagccctacctcgtcccgcgagccctcggcgctctgcacgcggaccgtgtaatccccctctgccatggcctcggccgcatcgcgcatctggcgcaggggagcggtcaacccacgcgagaagtagtaagtgatgcccagggcgaccaccagggtcaggggcatggcaatccagccggacagccctatcttgagtaagaaccaggccattacaaaggcgatggccgtggagatggtaatcaggaccgacagttccactttcaaagaggaaaaagctccgattggccggtcccgcccgggccgggcccctacggccgaagccaggaggcgcttgggggcggacgcgccagaggcagcggggcctcgcgttcgcttggatttcatcgcagcgattccttcaggaccggcctcgctcgccgttgtcctcaggcggctcgaaggcgtatcccacaccatgcacggtgcggatgagctgggcgccgagcttatggcgcagggccttgacgtgcgagtcgacggtacgggtgcccgaggcgtccacccagtcccagacctcctcaaggagcttctctctggtcaggaccgacttgggcttgcgggccagcgtggccagcaggtcaaactcggtgggggtcaagtggacctgctcgccgttctggctgacgatgcgctgggccgggtcgatgaccagggagccgaagtccaggagtttctcgttctccgagttcttggcgatgactttggcccgctcaacccggcgtaggagggccttgcagcgcgcgatcagctcccgcatggagaagggcttggtcatgtagtcatcggcgccggcacccaggccggtcaccttgtcggcctcgtcatcccgggcggtcaggataagaaccggcaccgggcgctcggcgacgatgcgcttggtggcctccaacccatccatgaccggcagcatgatatccatgatcaccaggtcgggcttgaattgcgaggccgcttgaacagcgctggccccgtccgaggccaccctggccgtccagccctcggctgtgacgcgctgggcgatggcggtggccagcgtcggttcgtcctcaactaccaggatggtggtcgctgccgcatagcggctcgtgttcttcatcatgctcgcttctgcctttacttactgacgcgctgaacgtgtatcttcctccaggatagtcatagggctaaaaaagtgtagacccagcgctttcccccggctcgcgcgtcgcgctggcggttggggcggcggcggtgaagtccacggtggatgtgaaaatatattggcatcattgcgtgtttattggcgttggctcaggctgttggcccgctggcgccgcttggagggtccatggattacaaggtcggcgatatggtcgtttatccgcgtcacggcgccgcccgggtggatgccgtgttggagcggacagtcaaaggggtcacccgcaagtacctccaactctccgtcctttcctcggacggcctggtcatcgacgtgcccgtggagaacgccaagaaggtgggcgtgcgcgacatcgtcgacggcaaggcggtgtctaaggtcttcctgattctgcgcacccctatcgtcgaagagaaggagatgaactggtcgcgccgatacaagctgaatgtggagaagatcgcgaccggcgaggtcaacaagatcgccgaggtggttcgtgacctctcccagcgtgacgtggatgagcacggcctgtcggcaggggagaagcggatgcttggcaaggcccgctccatcctgacttccgagatcgccctgtccgaggaaatcaccgaggaggaggcccagcgtttgctggatgtcaacctgggctaccaggagcctcgtccgggcgatgaaaagcatcacagcaaggcgcccaaggaacccgccgaccagaccttggcccgggtggctcagcaggccaagtccaaggcggctaaggccaaagcaaagcctaaggccaagaagtagtcgcgtttcgccgctaactcgttcaagagggacggccggggactgatcccggccgtccctcttgcgtgtgtcttgtgccgcatcggcgtcgggtaagcgttttcgcattcgctcccgtcccctggcccgacctgcgcggtcgggcaggtcggcttaccgggtccgtccggtcgcgcgctggttcgtcagggccttgcctgccttggccagcgcccacatcagggtggaaagggtcacgatgacgaaggagggcggggtcgggaacatggccgatatgaccaggccgccccagagcgagaccaagcagatgaggccggagacgaccatggctcgcaggggcgaggccgccaggatgttggcggtggccgcaggggtcacaatcagggcgaaaataagcagggtgcctacggctggcacagctatcgtgatgacgccggccatcagggccatgtagaccagattcatggccgcgatcggcacccccttggcctgggccacctgctcgtccagcgaggagaagaggaggggacggtagaccagggacaggacggcgatcaaaaccaggtcgaatgcagcgaaaccgatgatctgcccctgggtgaccgtcagaatcgatccgaacaggatggcctgcatttgctgggaggcggatgaggataggcgggcgaagaagaggcccagaccggtggcgaaggccaggaccgtgccggtggcgatctcccgctgggaggctttcttgcctagggcgccgatgaccaaggccccgcccaaggcgaacaaacccagcccggccgagaccggaaggcccaataagacagcgcctgtggcgccgggcaggcctatgtgggccagggcatgcgcggcgaaggtggagtggcgggctatcgtgaagtaacccatagccccagcggcgatggcgatcaggacgccggctacgatcgccttgagcatgaagggggccgagagggtttgcatccagcgcgggtcgaaggcgaaggcgctcatgaccgcctcccttccgctgccgaaggtcgggcctggtggtggtgttcctggacgatttcggtcggccggtgcaggtcgtggcttccctgggcggtctcgtcggtgcttgggctgatgaacatctcgccctggggggtgctgaccacttccacttgggtgccgtacaggtgggtcaggaggtcggagtcgagcaggtcgtggatgcctgcgtagtgggggtgcccgtccagcaggtagacggctccgtccaggattggcaggagcatgttcaggtcgtgggccaccacttgaatcgtcatgcccaactgtcggttgagccgggccaggacgtggaccgtctccctctggctggccagatcaaggttcgccaggggctcatccaacatcaggagcagggggtcgcaggccagcgcctgggctatggccacgcgctggcgcaggccgccggagagctcggagagccgcgagttggctctgtcctctatcccggtgaaagtcatggcttggtgcgcctggcggcgttcggcggaactggtgggccgggcgccgaagcgggtgccgttgactccaagcaggaccgattgctcgacggtcaggttggcatccacttcgctggtgtaggactggggcacgtatccgattcgatcgctctccttgcccgcgggctggcctaggacttggatggaccctgcggccagggggaggagccccagctcggtctgcatcagcgtggtcttgccggccccgttggtgccgacgatcgcggtgatggtgccggacggtatcgtgaagctaccgtggctccagatttcgcgtcctccgcgtctggccgccgcgttgaccaagacgatggcgtcttcttccttgctgtccgtctgcatgctccgcctctccgggaaggtgtggcgtatccccccctccactgcttattgattattgttctcaatatagacaatgggcccttccatccgactgcgcctgcggctaggctgattgggcacaggtggcgcagagtgaacgggggagggacccatggcggtgaagttggacggtaaggctcaggctgaacggatccgcgcagggcttgctgagcgagtggcggtcctgagcgcgcagggggagacccctggcctggggaccttgctggtgggggaggatcccgggtccgtgaaatacgtggaaggcaagcaccgcgactgcgcccaggtgggcatccgctccatccgccgtaggctgccggccacggccagcaccgcgcagatcgttcaggccgtggatgagttgaacgcggacccggcctgcaccggtttcatcgtccaactgcccctgcccgctggtgtggatcagacggaggtcatcgcccggatcgacccggccaaggacgcggacgggatgcatccggtcaacttgggccagctggtcctgcgcgcctccgggcctttgaacacgccgctgccctgcaccccgcgcggcatcctcaccctgctggaggcttaccggatcgacctgaacggtgctcaggtgtgcgtggtcggccgaggattgaccgtgggccgtacaatcgaactcctcctgaccaggcgcgagatcaacgccacggtcaccttgtgccacacgggcaccaagaacctgcccgagcagctgcgccgggccgatgtgatcatcgcggcggctgggcgagctggcctggtccgtgcccaggacgtcaagccgggcgccgtccttgtcgacgtgggcgtcacacgggcctgggaccaggagcgggggcgttggctgatcaagggcgacatcgatcccgcggcccgcgacgtatccagcgcgtacacgcccaatcccgggggagtggggcccatgacccgggcaatgctcctggccaatgtggtcgaggccgccgagcgcagggccgcaggaatggcgacacgcccggggatcatcggctgatttgaccgccccgtcacctatgatggaagaggccgggtgcatgcggatgcctgccgaaggttcacaattgaagactcataactgaatatggtcggtaatttcccgcttaactataagaaaactactcattaatggcagagaatacacaagaggtccctcaggtcgctatcaacgacatcggttccaaagaggacttcatcaaggcagtcgactccacgatcaagaacttcgacgatggggacctggttcaaggcacggtcgtcaagattgaccacgatgaggtactgctggacatcggctacaagaccgagggcgtgattcccgcccgcgagctttccatcaagaaggatgtggacccggatgaggtcgtccaggtcggcgacgaggttgaggccttggtcgtcaccaaggaggacaaggaaggccggctcatcctgtccaagaagcgtgcccagtacgagcgcgcctggggtgacatcgagaagatcaaggattccgacggtgtggtcgagggcacggtcatcgaggctgtcaagggcggcctgatcgtggacatcggcctgcgtggcttccttcccgcctccctggtcgagatgcgccgtgtacgcgacctgtccccctacattggccagaagattcaggccaagatcctggagctggacaagaaccgcaacaacgtggtcatctcccgccgtcagtacctggaagagacgcagtccgaagtgcgcgagaccttcatggcccagctcaagaagggccagatccgcgagggcacggtctcctccatcgtcaacttcggcgccttcgtcgacctgggcggtgtggacggcctgatccacgtttccgagctctcttggaagcacatcgaccacccctccgaggtcgtcaaggtcggacagaaggtcaccgtcgaggtcttggatgtcgacatggaccgcgagcgcatctccctgtcgctcaaggccacccaggaagacccctggcagcgcttcgcccgtactcatgtacccgggcaaatcgtcaagggcaaggtcaccaagattgtgcagttcggtgtcttcgtctccgtcgacgacggtatcgagggcctggtgcacatttccgagctggccaaccgccacgtggagaaccccgagtccgtggtcaagcagggcgaggagattttcgtcaaggtcatcgacgtggacctggatcgccgccgcatctccctgtccctcaagcaggccgacgattccgtcgacccggcttccgaggacttcgatccggccatctacggcatgcccgcagagtacgacgatgagggcaactacaagtaccccgagggcttcgacccgaccaccaacgagtggatcgccggttacgagaagcagcgcgaggagtgggaggcccagtacgcggccgctcacgacctgtgggagcagcacaaggccttcgtgaccaaggagatggagaacgccgaagcctcagcggctgaggacgccaagagctccgaatccgcttccgcttcctcctccagccagccttccggcaagggccatcagcccgcgtccgacggcgctgccactaactacacctccgaggcttcctcggagggcaccctggcttccgatgaccagctggccgccctgcgcgagcagctcctcaaggagaagcagtgagccgttgaccctgtgatgggtcgcggttacgatacggcggaaggcctggcaccctgtggggtcaggccttccgccgtatgcggatacgtgtggcgccaagctgggttcggcttggcggtttaggggaggggacccatgctgagagtagggctgacgggagggatagccgcaggcaagagcacggtttcccgtcgcttgggagagctgggggcttgggtcatcgactatgaccggatcgcccaccggatcatggaggcaggcggcgcggccgtcgagccgatcaggaaagccttcggcgggcgggccattgggagtgacggctcggtggaccgagcctggttggctgaccgagtgttcgcttcgggtgacttgctggcgcgcttggatgccttgacccaccccttgatccgccagcaagccatgcatgaggaggagccttggaggggcagtgaccgcgtcgtcgtccatgacatcccccttttgacggaaatcatcgggtcgattcccctgacgttcgaccggatcatcacggttgaagcgccggagcaggtgcgcgttgcgcggatggtgaacgagcggcatatgagccgcagccaagcgattgcccgggtgaatgcccaagccagcgaggctgaccggcgtggccttgctgataccgtgatcgattcctcgctcgctatcgaacagatgttcgaacaggttgatacaatatatgaagaattgagccaccaagcccagacccaaggggagccgggccgaagggcttgagcgcgcagaggtcttgccatcgcaggagaaggagcagcatggggttcaacatagagcgcaccgacaagccgttcgtggtcaagtcgccctaccagccctcgggcgaccagccccaggccattgatgagttggccaaccgcattgagaatggtgagaacgacgtggtcctgatgggggccactggcaccggcaagacggcgaccacggcctggctgattgagaggcttcagcgcccaaccctgatcctggagcccaacaagaccctggccgcccagttgtgcgcggagttccgcgagctcatgcccgacaacgcggtctcatacttcgtctcctattacgattactaccagcccgaggcctacattccgcagaccgatacctacatcgagaaggattcgaacatcaacgacgacgtggaacgcttgcgccatgccgccaccgccaacctcctgacccgccgggactgcgtggtcgtggccacggtctcctgcatctatggcctgggcactcccgaggaatacgccggccgtatgctcttcctgcgagaagggcagcaaatcagccgggaggagctcctgcgcaagttcgtggatatgcagtacaagcgtaatgacatcgccttcacccggggcactttccgggtccggggcgacacggtcgagatcatcccggtctacgaggagctggccgtgcgcatcgagttcttcggcgacgagatagaccgcatctccaccttgcacccattgactggcgacgaaatagctcacgagagccaggttcacatctttcccgcctcccactacgtggcgggccctgagcggatgcagcgggccctgaagaccatcaaggaggagttggactggcgggtgggccagctgcgcaagcaaggcaaggagctggaggcccaacggctaaccatgcgcaccacctacgacttggagatgcttacccaaatcggcacttgctcgggcgtggagaactactcccgccacttcgacgggcgggaacccggcacggccccgcacaccctactggatttcttccctgacgacttcctcctggtcatcgacgaatcccacgtcaccgtcccgcaaatcggggccatgtacgagggggacgcctcccgcaagcgcacccttgtggagcatggcttccgcctgccttcagccatggataaccggccgctcaagtggcctgagttccttgataaggttggtcagaccgtctacctgtcggccacgccgggcgactatgaaatgggtttgtcggatggcgtggttgaacagatcatcaggcctaccgggctcctggaccccgaggtggaggtgcggccggtcaagggccaagtggatgacctcttggcggagatcaaggaccgggtggctcgtcatgagcgcgtcctggtgaccaccctgaccaagaagatggccgaggacctgactgactacctgttggagcgcgacatcaaggttgaatacctgcactcggatgtggacaccctgcgccgggtggagctcctgcgtgaactgcgcgaaggcaagatcgacgtgattgtgggcatcaacctcctgcgcgagggactggacctgccggaggtgtccctggtggccatccttgacgccgacaaggaaggcttcctgcgctcctaccgctccctgatccagacgattggtcgcgccgcgaggaacgtgtcgggcaccgtgatcatgtacgccgatgagcagaccgattccatgaagaaagccatcgacgaaaccaaccgcaggcgggccaagcaaatcgcctataacaaggcgcacggggtcgatcccaagcccctgatcaaaaagatctccgatgtcaacgacatgttggccaaggaggatgtcgacacgcagaccctcttggagggtggttaccgtaacgcaggaaaggctggcaactcacacttgggcgtgccttccttcagcaaggaggaggcggacaagcgccaccaggagatactcaaggccggtctgccggcgcaggacctggccgatttgattcgtcaactgagcgaacagatgcacacggccgccgagcagctccagttcgagctggcagcccgcctgcgcgatgagattcgcgatttgaagaaagagctgcggcaaatgaccgaggccagcaagtaattcgccaagcctcgcccgcccctcgcgcccacgtggtggcagagtctgtcgcaaagtaccggtacagtaggcctatgtctgagaccccacttgcattcatggtcgtcacactcatcctccttgccgttttcgtcgtggttgatcttttcgtgattggccgcaggcctcatgtgccctctacgaaggagtgcgtgcagcacatagccttcttcgttgtcgcggccctgctcttcggcggcgtgctctggttgatttccggcccccagccggccatcgagttctactcaggctggttgacggagtactccctgtccatcgacaatctctttgttttcgtgattatcatgggccagttcgcggtgccccgccagctccaaaagtacgtgttgagcgtgggcatcgccatcgccttggtcctgcgcggcgtcttcatcctcgtcggtgtcaccctgattgaccgcttcacttggatattcttcatcttcggcgtcttcctgctctacacctccttcaaggtcgccaggggccaggacgaggggggttataaggagaaccgcctggtgggttccctgcgccgggtcatgcgcatcagcgatgcctacgatggtgagcgtttgaccgtcaagcgcgatggcgtgacgtatttcacccccatgctgattgtcttcctggccatcggcacgaccgacgtgatgttcgccttcgattcgattccggcgattttcggcctgacccacgatcccttcatcgttttcacctccaatgtcttcgcccttctgggacttcaacagctctacttcctgctgggggccatgcttgacaagctggcctacctgccgatcggtctgtcgatcgtgctggccttcatcggcgtcaagctgatcatggaggccctgcatggcaactccctgcccttcatcaatggtggccaaccgcttgacgcggttcctgaagtacccacctggctctccttggccgtcatcgtcctggccataggcggcgcctcgctggcctccttgattaaggcccgcaggtcctccttgaagacctcctggcacaaagacggtgacgagtgaggtcggctaatcgcttgattcacaggtattgtgagcgctaacgtagaaaacctgccacccgtcgcctgagccgagtagactggccctagtgagtgcctgggggtcatcctcaggcctggaacaacactgaatgaaaaggtaggcaggcatcgtatgcgcaaagccaagatcgtagacaccatcggaccagcctcggagtccttggaggagattaccaagctcgtcgaggccggtatggatgtggcccggctcaaccgttcccacggcacgcccgaggaccatctgaaggtctacaacaacctgcgcgaggccagcaagaagactgggcgcaacgtggcggccctggtcgatctgcaaggccccaagattcgctgcggttggttcaagaagaacgccgagggcgaggataaggtccagctcaaggaaggccaggagttcatcatcaccaccgacgatgtcgagggcgacgagcacatgacctccaccaccttcaagggcctgcccggcgactgccacaagggcgatcccatcctgatcgatgacggcaaggtccgcttggaagtcaccgaggtcgagggcaacaacgtgcacaccaaggtcatcgtcgccggcccggtctcctcccacaagggcatcaacctgcccggcgtggccgtgagcctgcccgctctgaccgagaaggacgaggccgacctgcgttggggcatccagaccggcgctgacatcatcgccatgtccttcgtccgcttcgccaccgacatcaaccgcgcccacgagatcatggacgaagaaggccgccgcatcccgatcgtcgccaagatcgagaagcctcaggccgtcgagaatctggaggagatcgtcaaggccttcgatggcatcatggtcgcccgtggcgatatggctgtggagatgcctttcgaggaggtccccttggtcaccaagcgctgcattgagctggcgcgtcagtacgccaagcccgtcatcgtggccactgaggtcctgggctcgatggtccattccccgatccccacccgcgccgaggcttccgactgcgccaacgccatcctggatggcgcggacgcgacgatgacctccaacgagaccgccgttggcgattacccggacgtgaccgtctccacgatggcccgtatctctggctacgccaccgctcatggcttcgaccgcatcccggttatgaaggacctggacatgtcgaattccggcgccgtctcctcggcagccgtcgatctggccgacaagctcaacgccaaggccatcgtagcgttcactcagaccggtgacaccgtccaccgcgtctcccgtgagcgtccggccgccccgatttacgcactgaccaacaacgagcacaccttccactggctggccctgtcctggggcaccgaggccttcctgtgcgagcaggactaccacggtctgacccgtgagaagctcatgggctacctggacaagatcctcaagggcgccggcaagctggccgacggcgacaaggtggttgtcctgtcctgcggtcaggtcgagcacgagccaggctccaccgactccatctacgtgcacacagtcggcaaggccgagtgaacgcatcgataagcgccagctgagttcacacgctcggccccgctatcagcgaaggcccggcgacctccacgaggagaggtcgccgggccttcgctgatcccttagccgatcaggtcaggtcggttaggcctatccgagcccgtaggatcgctatcacggttttcgcgtcgatcaccgttccggcgatgaccatccggtaggcttcgtccacagtgaacaggcggacatcctggtggggcgtctccggtttcaagcttcctcgtgcggctggcgtcaagccttgggcgtaaaagagcgaggtgtagtggctggagtacgagggcgtattgacgaatcgggcgaactgatggaagttcttcgcttcgtacccggcttcctcgcgcagcttgcgggccgctacgtcgaccggccgctccttgtcgttcaaggggtgcccggccggcagctccaaagtccagcggtgggaaggcaggcgatattgctccaccagcggaatcctgccatcgtcggtcaaagccatgaccgcgatcgtgtcgccgttcttttcgttgacaatgcagcgtttgaagcgttccccgtcaatcgacagataggagacttcgtcgacgctgtagtagtgactgtccatgatctggcgtcgatccacctcttgcacgggggagggcctccacggatcgaacctgcgataaacctgtgtgttcataagcgcccttcttcaaaaggattgtggcatcctcgctcgcttcttattgtaggccttggcccctctgcggtccaggcaacacggcgtccgtgcgtcgtctggtgggtgtggtacattctgacaagaaagaatttagcccccgtatcccaattggtagaggaaacggcctcaaaatccgtgcagtgtgagttcgagtctcaccgggggcacgatgcacgcgaacctcggccaggcgccgcacatgcaggcgcgggttgggaagacagacatggaaacgaggttgacattggctgctgagagcaagacatacagcgacgagcctgaagggcggacggtcgtcgtcgcggaggatgaagctttaatccggctggacacggtggaggcgcttgaggatgccggctatgaggtcgtagggcaggcggccagcggccaggaagctgttgacttgacacgtgagttcaagcccgacgtggtggtcatggacgtcaagatgcctggtaaggacggaatcgaggcggcgaccgagatcggcgaggagaacctcgctcccgtcgtcatgctcacggccttctcccagcagagcctggtggagaaagccgccgacgcaggcgctatggcctatgtggtcaagcccttcgcgccggagaagctgctgcctgccatcgaggtggccatctcccggcatgaccagatcaatgccttgaaggatgaggtcaccgacatgaaggcccgtttcgaagcccgcaagcgggtggatcgggccaagggtctgctgatggagaacatggggctcactgagtccgaagccttccgttggattcagaagacttcgatggaccgcaggctgacgatgcaggaagtagcggatgcggtgattgaccaggtgcaaggcgacgactagcgagcacaggtgaaggggcggcgcgcatgagtggcgcagatcaaaaggcgagcggcaaaggacccctgcttgtagtggatgggcactccctggccttccgggcttattacgctcttccggtcgattccttcaccacctcgaacgggcagccgaccaacgccgtttggggcttcgcgatcatgctctccgaggtgatcaccgccgagcagcccacccggatgtgcgtggctttcgacatggcaggcgggaccttccgcaacaagatgatgcccggctataagggcacgcggcaggcggcgccagaggaactcctgagtcagttgcccctgatccagaacttcctggagaccttgagcgtgcgatacatcgagaagcagggctacgagggcgacgacatcatcggcaccctggctacgatgggggaggacgcgggctaccggaccctggtcctgtcgggagaccgggacgccttccaactggctgacgaccatgtcaccgttcttttccctggttatcatttccgtcagcttaagcgcatgacccctgaggccattcaggagaagtaccacgtgagccccgaggtctacccggatctggcggccctacgcggcgagcagtccgacaacatccccggggtaccgggtgtcggcgacaccttcgcggcccgctggctcaacgagtacggcgacctggaagccgtcctggataacgctgagaagatcaaaggcaagaagggcgaggccctgcgcaagtgcatcgggcaaatcagactcaaccgcaaggtcaatgccctggtgcgggatttggacctgggcgtcacggttgacgacttgggtttcggacgcattcataccgataaggtcaacgccctcttcgaccgcttggaattcggctcgcacacccgcaacaaaattctcaagggattcaactgtgtggaggatttcgagggaacgggactgcctgacaacagcaagaagaccgacgagtccgagaccggcctggccttccaaacccccaaggctgatcctgtcgaggatgtggaagcattcgaagcttggtgccgcgagcacctgcccagcccgaaggagtccagcgaactcgctgaaaccatgccggatgcggagccggtcattcaggcggcgggtgacggtctgaaagccgcccaagcccaggatacggcctgcccggacctgtccaagcaatcgtggtatctccatgccgagggatcatccaagcccggcgccgccaagctggaacgcctgaccgtccttgcaccggacgggcacgccatcgtgctcgaggaccagcaagtgtcaggagacctgaaccaggcccttgcgacgatgctcgccgaacgaatctccagctgcacggtatacggctataaggagcacacccacctgctcagcgctgctgggttgacgctgccgatgcctctgttcgacgccaagctggccggttacctggtggagcctgacttccatgcggttgatttggagaaggctttcgcccacttccttcatgtgctgatgaacgatgacgagcagcccgaggtggaacaaggggccttggacttcgacggcgacgaggatgccgagcgcgacaagcccaccgatgagcaaatcgccctgaatcgggtcgagtacgtcagattgctggccgagcacctgaagccgctgattgaagagcgccgccaattcaacctcctgcgcatcatcgagatgcccacctccacggttctgaccggtatggaggaccagggcgcgaaggttgacttggaccgcttgaagggcatgggagatcagttcggcgctgaagctcaagaggcgcaagccatcgcttgggatcgggccggcgaagaggtcaacctccagagccccaagcagctgcaaaaggtcctgtttgaggatttgggcctcaagccgatcaaacgtaccaagaacgggtcttattcgaccaacgcggcttccctccaacgcctgtatttgacttcggtgggcaatgaacgcgccaacgattttttgggcgccctcctgcgacaccgggagaccaacaagctcaagcagatcgtcaattccctgatggagacggtcaacccccgtgacggccgcatccacaccacattcgaacagaccgtggccgcgaccggacgcttgagctcggtggaccccaacctccagaacataccgaataagaacgccgcgggccgtgagattcgctccgccttcgtgcctggcgagcgcttcgagtccctgctgagctgcgactactcgcaggtggagctgcgcatcatggctgacttgtccggtgacgaggcgcttattgacgctttcaagtcaggcgctgacttccacaagtacgtggcctccctggtttatgggatcagcatggacgaggttacgcctgaccagcgctcccacgtcaaagccatgagctacgggctggcctacgggctgtccacctacggcctggcccagcagctcaacgtcagcccggccgaggcggacgtcctgcgctcccagtacttctccaccttcggcaaggtccatgactacctggagtccctggtctccgacgcttcagtcaagggctacaccgagaccatcttcggccgccgccgctacttccctggtctacggtccaagcgacggaccacacgtgaggcggcagagcgcgccgccttgaacgcgccgattcaaggttcggcggcggacatcatgaagatagcgatgattaaagcccagcactccctggcccaggctggatgcaagagccgtatcatcctgcaaatccacgacgaactcgtgctcgaggtcgctcatggagagcaggagcaggtgaccgacctggtgacggatgccatggagcacgccgtcaagttggccgtacccttggatgtgtccaccggtatcggggcggactggcagcaggccgctcactgacccggccaagcggctgtccgttatacgtctgaagggcgcgttgaggctcgcatcagtgcggggaagggaggcctgacatggcggagcaggttcgcgcgaaagcggcgtcaaccgtgagtctgggggaggtcgttcagatccttgaacggctctatccgctctcctacgccgaagattgggaccatcccggtctgattgttggcagcgcggactggccggtcagtaaggtcttttgcgcggtcgatccaaccttggacgtagtggaggaagccatcgcatctggagcccagctcttgatctgccatcacccccttttctttcgctcggtgcacgaggtgggagggttcggcttccgtggcggaatcgtcacacgcttgattgaatcgcgctgcggcctgtgggtagggcatacgaacgccgacgccgcggtgcgaggcgtggcccaggcggccgccgatctcatggggatacttgaccagcgccccctgaaggaggtaggcctcgacccgaacgactggagcatacgcgacggatccaccaagcatgaatcggtcggtctgggccgggtgggccgtttgcccgccaccatgcgcttggaggacttcgccaggcgggtcgccggccttctgccccgcactcagctaggcgttcaggtggcaggcgagccggacgcccgcatgcagaccgtcgcccttctgccggggtcaggtgattccatgttcgacgaggtccgcgccagcggggttgatgtctatgtgacgagtgacctgcgccatcatccggctacagacgcctaccagcaggccgtctatgaggcccggctgcgtcgccgcgaggatgccggtgggactgcgcgcccacttttaatcaacactccccatgcggcgattgagagtctctggttcacctatgcggcaaaggacattcagcaggcggttcatgaggcgaccggagcctgtttggatctgcaggtcatcgatcggtcaacggatccatggacgttttcgattcagtagccggcaggagtgctggcggcgttcgggtatgccgtgaggcgtgagcgccagtaggaggagcaaggatgacgatggatgttgacgggcgaggcagagcgattcttaatcctgcagagcgtttcgcgaccggtcgggatggggtcgatatggacgcaccgacccggttggtcagcagcaggaccgtattcgagggacctattttcaccatccaggaccagcgcatcgccctggccaaggccgacgggggccggaccatgatccgtcggcagctcgtgcatcatgccccctgcgtggtcatgctggtgcaggacgcgatcaccgaccgttacctgctggaacgggagtatcgggtgggggtttcgggctatacgttcggcctgcccgccggattcatggatcctggtgaggatcctgccaccgcggccctacgcgaactcagggaggaaaccggggtggaaccagctgggcagggcgcttaccagatcgagcgggtggcggattgctactcttccgaaggcatgagcgatgagttggtccacattatgattatccgcctgcgctcctggaggaaggagctgacccgtttcgacgcggacgagcatgtccaatccgcctgggtgtcttggccggagctgcgcgccttgcctgtcaccgcatccaacgcggtcatcgccatccaagccgaggcccttcaccgcttgaggagcgtgtgctgagcagccgtgagcgtccccgtctcgtatgacggtgcggtggcgacgggattccagagatgaaggcgaaactggcgtagcccatggcggatggggccaccaccgttcttgcgctttgcatcctgcggcccgctgttgctaatcgtgaggaacgttcaccggtgagcatttgcgcgcaagtccgccctagggctcagcgctacggtttccgccggcgctccatgaaaccctgtatggcccggcaggagcgctcctaccgggccatacagggtttcactgctgggtgtgaaccgtcatccagccatggcggtgtcagtcgaccagggtgtgattgatggcaggctggaccttagcagtggaggggagagcgggctgttcggcgcgggacatggcctggtcgaagtcgcgggtgcccttgaagacctctttggtccaggggttgatgtgctgcttcttggcgcgccggaggatgtagcccaaggccaggacgttagcggccaaggagatgagcgagacggtcaggttcacactcgggttgttgaccgactgtacggcgaagcgggagtggttctgatccaggaagaacgggaagacctgggcgaacatgcaccagatggccagtgtgttggcgcggttctggatccaggcgcccttgttccataggaagttggcgaaggtgggggccaggagcagggccaggccgcagtaccatgcgtgggtgggaaggcagttgtaggtgtagcagaagttccaaatatcgtaagcgacgatgaagatccaggtcatgtcgggccagagcatgtcctgcttcttcttggaagcgtagatgccgaaccaaccggtcatgcagaagatgttgatcaggccggcgatgccgttgaagacgttaaaccagccgcccatcagcgtgacgccttcgctggagacgaacgtgccgccccagccgcggaaggcggactcgaagtcggaggccacggcgatcaggatgttgatggctacgatgatgaacgggaagcacttgaaccagttgactttacccagtttgccccagccatacttgaggatcatgaagccgatgcagccggcggtggcggcatagagcttagcgtagtggaaccacccgttcatctctgtgtacgtggggttgttcaacgcccagctggcgcccctggcggcccccacgtaaatggcgatgaagtaggcgctcaaagccacggggattcccacgaagcagacgagccctccggttttggtccgccgcgcgatttcgttggcgccaatcaaagcacagaataccagtgcccagccgagccattgatagatggcgttggagccgtagacttggaataacacggtgctcacttcctttgttctctcgtgaattcttctttttcctgcgttcccgccaaccgtggaggccggtcgccggccgcaaaatcctttatatgtaggcttccaggtgcaaggtctgggcgacaatctctttgatggtggcatcgtctacctgcggctgctcgcgcaggagagcgacggaaccggagatgaggatcatcaaggtctccttgatgtggcggacgggcaagccggagtggatgcgctcgaagtccttgaccgtggtcgagcagatgtagtcagccacgcgctcggacatctggtcaacgaactggatgtagagggcgccgttgcctgactggaccattctcttgctaaaggggccttcatcgttgatgatggcccgcatgagcgtcaccaggtcgtccaaggccttgtcgatgttgcctgtctcgcgttccccgttccaagtgtccagcttggcgataatggtgttggtcgcgtcgtcgagcactgccgcggccacgtcttccttgttgcggaagtaatggtagaagagggaacgggtgatgccgatcttacgggttatgtcaccgatcgtgatgtgagcgtagcctttttccaggcaaatgtcgtggaaggttcgcacgatttgctcacggcgcctggggacttgggatccagccttggctgggaagttagcggtggcctgctgacctgccaagccgactgctgtcatcacgctctccttgtcgttgttgccgaggtccgcgtaaacgcttcaagagccgagaaccgcaatgttcttgacaatgtgtcaacgctgatgaacccagtatagaacgtctcttgacactgtgtcaattcgcgggaatccttgtggccgaacgggggcatcgcattcctgagacggactaatggcatgggccataccgtcgatgggcccttggaaagagatggagcgtgtcttgccgtcatcgtaggagcccgctatatgggccgtcgggagaggagaggactcggatgaacagggggccgggcgttgattcggaatgagccgggcctgcggcagcgctgtcaccgaatcggggctaagtcgggctagcgggatttgaacccacgacatcctgcacccaaagcaggcgcgctaccaagctgcgctatagcccgaggcctggaacgaaccaggcgcaatccaatagtatagcgcgaggggagggacgaggactttcccgtgggcattcaaccgcgatggtggcgagagcgactgggaaggggataaaattagaggaagtcgtgtcttgtatgacttgaggagaagtccgggcgcgcagcaggaccggaggttgggtgctcagcccgcggtcgtcactgataagagaaggacacgagaatcagcatgaacgagaatgagaatccgcaggagccccaggagccgcaggctcagaacggtcccgctaccgcgccgggccagggagctcagccaggacctcaggcacagtccgaagcctcggcgcagtcttcatcgatggcgcagggccaggcgcctgcgtccccagagcaggctgcttctgcgacttcgggcgcccccggtggggcagatgttcagggccagcagggtcaacccgctcccgactacaagatggcggcggagcagccgggtcaaggcgcgaccaagactaagcgcacttggttgattgtggccgtcgtggttgttgtaatcgcagccctggcagccgccgtcctggtcatgaagccttgggcgcccaagccggctgactaccggcaggcggccaacgctgccgcggacatccgcagccaaaagaacaaaatcgccgatcagttgggcgaggcttatatcgctgcgggtgatcccaacaaggagttcagtcagcaggatgtcgataagctgaagaactccatcgacaagctcgatcagatgaacaaggacttcgccaaacagaaggccgtcaaggacaaggacgtgaacgccaagtaccagacctatctggagaagtccaagcggtacgacgctttcgtgggcgatttggccgcttccgcgcccgcatacgccaaggcaggaaaggcctgcgggcaagagccggaattggccagtacctcggacaccacggaatacctgaacaaggtgaacgatttcatctcctcgtgcaaggccagtcttgacgccgtagtgaaagcgcccaataaaaccttatcggattacgcgaaggagacttccggtagcttgtcccaactccaggatgtcctcaagcaaaccggcgatctggtcaacaacctgaactccgacaatttgagtcagagcatgtcgaagcttacggatttggagcagcaggcgagggacatagagaaggacacgccaaagtccctggaggtgagaagcaatctgagggatgaagagaagaaggtcagcccggatgcgtctttgaacgatctctatcagattttgcagaataaagcaggcaagtaaaaagtcaggctggcgcgggcgatgagcgtggcgtcagcctagcggctgggcgagtctgaatacaccccaagggcccatgaagcggttttccgcctcctgggcccttggggtattcttgcgcttaccgagcggtcacatcacttgccgaagacgttgccgtatgagtcgccatctcgggcgatgacttcggactggcgggcgattgagagttcctcgttggtcgggatcacgcaaatcgtcactgtgctgtcgggcgtggagatgatgcgaggctcctttgaacgtacatcgttcttggccgcatccagcttgacgccgaagggggccagctggttgatgaccgcggcgcggacgatctcgtcgttctcgccgacgcctgcggtgaaggtgagcacatccagaccgcccatctgagccgtgtagttgccgatgtagccgacgatgcggtggacgtagacatccagggccagcttggcgtcctcattgccctcagccaccagccggtggacctcacgcatgtcgccgaaaccggtcatgccggtcatgccggactgcttattgaacagggtgtccagctggtcgacgtccatgttggcgttacgaatcaggtggaagaccacggccggatcgatatcgccggtgcggctacccatgaccaggccttccagcggggtcaggcccatcgaagtctcgaccgggcggcccgaaacctgagccgaagccgaagcgccgttgccgatgtggaggacgatctgcttgaggccttccgccggcttgcccgcaaccttgggagccatggagccgacgtactggtggctggtgccgtgagcgccatagcggtgaatgtggtacttctcagcgacttccttgttcagggcgtaggtggacgccttcttcggcagctcgaagaagaaggaggagtcgaacacgaagacctgcggcgtatcaggcaggagcctgctcatcacttcggcgcctgtggcttcaggcccgttgtggagaggggccagcacagccaggtctttgacctgggcgatggtcttgtcggtcaccagggccggcttggggaagatggaaccaccctggaccacgcggtggccgaccgcgacgatgccggactcagtcaagttggggccatattcctcgaagaagcccaggacccgcttcagaccggtcccgtggtccggaatcggctcctcaagctcgtgcttgctgccctggtactcgtgcttgtaatggccgtcgatgggctcgccgatcttctcgaccagacccgaggccaagccctcgccggtttccaggtccaccagctggtacttgattgagctggagcccgaattgatgactaggacggttctcgccattgtggcatcctcctgatgctgtacgttaggggagcgaagaactccccatttccttggttcagattacgcgccggggcttacaatgctggtcggcgcaagcaattgagaaagcgggccgtctgtggcaggcgggcccgctttccttctatgtctgctatgtcttcagcgcaggtgctgcgtcgaaggcctcactcgtcttgggcctcgaccgcggtcagagccacggtgttgatgatgtcctggaccagagcgccgcgagagaggtcgttgaccggcctgttgagcccctgcaggaccgggccgatggccagggcgcccgaggagcgttgcaccgctttgtagccgatgttgccggccgccagtgaggggaagacgaatacgttaacatggcctgcgacttcgttgcccttggccttggcggcggccacggtgggcgaccaagcggcgtcgaactgaatcgagccgacgatcggcaggtcgggcgccttctccttggccagcctcgtggcctcctcgaccaggtccacgtccgggcccttgccggaacccaaagtggagtaagagagcatgccgacccgtggctcaatcccgaaagcccgtgcggtctgggccgactggatggcgatgtccgccagctgctcggcggtggggttcagattgatggcgcagtcggcgaagactgccacgtggtccttgaagcacatgaggaaggcgccggagaccagggaagcgccgggcttggtcttgatgacctgaagggccgggcgcactgtattggcggtcgagttgacggagccggagaccaagccgtcggcgagaccctggacgaccagcatagtgccgaagtaagaggggtctttcagctgctgtcgggcctgctcctcggtcatgcctttcttggcgcgcagggcgcacagcttgctgatcatgggggtcagcacggcctcgtcgtccatgctttggaaagaggcctgccctaggtgctccaggcccagctcgcctgcgcgcttgaggatggccgcttgctcgccgacgatgatcagcttgacgatgccgcgctccagcaggtaatcggccgccttgagaatgcggtcctcgccgccctcgggcaggacgatggtcttctggccggccttggcgcgctccaacaggtcgttctggaaggcgatgggtgtggtcacttggacggagggcccttcggcggccttgacgatttgatcggcgggcgcgcaggattggaaggccttcagcgcctgctcatggctttcggtggcctcgggcgcgggatcgaactccattcgatcaaccagccagcagggctgatcgtaaccggcaaagcgctcctggagtccgggtttatcgtcctgctcgcatccggtgacaaagacccccgccaggcggctgcctgccccctcgacgatgccgcggcaggtcgccacgctttggaagacctgctcgggggtgcgctcaatcgtgcagacggccaggaagaccggggatcgcaaatcggctgcgatgtcggcgtccaagaccatgcgggtcggatcggcgacgggggtcttatcggaacctacaatcaacacggcctcgggctgctccttcgcggtgagcgcgctataggcggcgaccgcgtcggcgcgggcctgctcccgatccgtgcgggccttgccggggcaggtggccacggacaggccacgactggcttcactgccgcaggccttgagcagggtttcggtcagccgctccttccggcaggcgatgggccgtaagagggcgaccttcttggaggccgccaaagcttgggccacgccgtaagccacaacgttgcggccggtgcctgcttcggggctgatgatactgatattgataggactcactgaagtcccctcctgtccatgattaatctcgccatgagcgttggctgtgaccgcttcgttcacgccttgcgcccgccaccagtataggctacaagcccaacaagctgccttgggccgtcgcactggggtcgggggaggaggggaggcctcgtaaataagagaaagggcgccagcggcgcgtatgcgcgtcactggcgcccctaacggggttgaacatgggctggtagctaatgcacctggaccctgtccaacctagtggcgggccgtaaggctcactcgttgtccccggccgtggcagcggtcgccgagatgttcttctgaccggcgcggttggcgtcaggccagacgaaatcggtgtaagcggggtggtcgtagccattgtccaccgcgaactggaaggcctcggtgcggaacttggtccactcgtcgatctgaccggcgtacttcttggcatccaccagctcaagggcggaggccgccaagcaccaacgatccatgtcgttgacgcgcaccatgtcgaagggcgtagtggtagaaccctgctccttgtaaccgtgcaccgtgaagttgtcgtggttgggacggccgtggatcaggcggtagatcgagcccgggtaggcgtggaaggcgaacaggaccggcttgtccttgctgaagagctcggtgaactcctcgtcggagatcgcctggtcgttctcttcgacgtcctggagcttgagcaggtccaccacgttgacgaactggaccttgatgcccatcttctggagcatgtcgtcggctgccagggcctcttgggtggggatgtcaccagccgtggcgatgaccacgtcagcatcctcggcgtccttggcgttggaagcccaatcccaacgtgcggcgcccttctccagctcagccttggcctcgtccacgctctggtaggtggccgcgggctgcttaccggcgaagatcgcgttgatgcagttggtggacttgtaggcacgctcgcccacagccagcagcatgttcgcatcggacgggaagtagatgttgaccacgtggtcgttgttgaaggatttgttcagcaggatgtccacgaaaccggggtcctggtgggagaagccgttgtgatcctggcgccacacgtgggaggtgaccaggacgttgaggccagcgatgggcttgcgccaaggaatctcacggaccgtggcttccagccacttggcgtgctggttgatcatggagtcgatcacatgcacgaaggactcgtaggtggaccagatgccgtgacggccggtgagcaggtagccctccaggaagccttccatctggttctccgacagctgctcgatcacctggccggtgtgggccatgtgctcgtcggtcagctcggagaggtactcggcgtcccactgcttgttggtcacctcgtaagcggcggccagacggttggaggccgtctcgtcggggccgaagatgcggaaatcggtggggttcttggccagcacgtcgcgggtgtagtagcccagcacgcgggtggcctcggtggcgccccagccatggccgtggctcttgacgtcgatttcgtaatcgtggatgtcgggcaggtccaggggcttcagcagacggccgccgttggcgttcgggttctcgccgatgcgcaggtcgcccttaggcatgaaggaggtgacctcggggcggacggctcccttatcgtcgaagagctcggcgggcttgtaagactccagccagcccttgaggacctggaagtgggcctcggtgtcgcgggcggaggccagcggcacctgatgggcgcgccaagagccttcggtcttcttgccgtcgatgaacttggggcaggtccaacccttgggcgtgcggaagatgatcatcggatagaagggccgggtcatgtcgtcggtctgggccagggccttgatctcgcagatgtcgtcgaagacggactccagcaggtcggcgaaccggcggtggatggacatgtggctctcgtcgtcgaagccggcgacgaactcgtgaggctcgtaacccatgccgtggaagaactcgtggagctcctcatcggagatgcgcgaaaggatggtcgggttggcgatcttgtaaccattcaggtgcaggatcggcagcactatgccatcggtgcgggggttgaccagcttgttggactgccaggaggtggccagggcgccggtctcagcctcgccgtcgcccacgaccgcgggcacgaagagggaggggttgttcatgaccgctccataggcgtgggacagggcgtaacccagctcgccgccctcgtggatggacccgggggtctcaggcgcgaagtgggaggggatgccgcccgggtaggagaactggcggaagaacttctgcaggccagcctcgtccttggtgatgttagggaagtactcgctgtaggtgccgtccaggtaggactgcgaggtgccggcggggccaccgtggcccgggcccatgatgaagaccgtgttctgctggtggtcagcgatcaggcggttcaggtggcccagcaggaagttcaagccaggagtggtgccccagtggccgacgagacggtgcttgacgtcttcgcgggtgaacggctccctcatcagcgggttgctgcgaaggtaaatctggccgatggagaggtagttggctgcacgccaatacttgtcgacagcttccagggtctcctcggaaaccggagcgtcgagcttcttccaaggggtgccgataacaggattcgtcatgtgtactcctgcactatagtgcgattgattcttttcgttcggtagtaaagcgccgacaggccctctggccagtccgaccccttatttcccaatcgctctcatggtacgtggaagaggcgactttctggactttttagttgcaggcgtgttcatatatgttcggatgggggcacattcatgttcatttgctcgaaagtggcggaattgcaggcttttgcgtaggctgtccgattgtcgtgggccgcctgggcgggaagcggcggtcccggtcttgcgctgtgggctgcaagctgaggtcggcttgtctgaaagggcgttcataatcgaggcacaagcaaatgcaagaagataataataaggagcgtcatggcagcaggacccgttctggtagtcgatttcggggctcagtacgcccagctcatcgctaggagggtgcgcgaggcgcatgtttactccgagctggtgccgcactcgatgccggtggagcggatgctggccatggatcccaaggccatcatcctttccggtgggcccgcttcggtctatgtcgagggcgcgcctacgctggatcccgccattttcgaggccggcgtgccggtgctgggcatctgctatggcttccaggtcatggcccacgagctcggcggcgtcgtgaacaaggcggccctgggggagtacggtaagaccgagacggtgatcgaccgggctgaagggctgctggctggttccccggacaagcagaccacctggatgagccatggtgtggccgtcgaacaagcgccggagggcttccaggtgctggctcacaccgcaggagcgccagtcgccgccatgcaggaccccgcccgcaagctctacggggttcaatggcatcctgaggtcaagcacacccccttgggtcaggagctcatctccaccttcctgcatcagtgcgctggcctggccgatgattgggacccttccagcatcatcgaggaccaagtggccgccatccgagccaaggtcggctccgaccaggtcatctgcggcctgtccggcggggtggactcggcagtggcagcggccctggttcacaaggcgatcggcgaccagttgacttgcgtcttcgtcgaccacgggctgctgcgcaagggcgaagcccagcaggtgaaacatgacttcgtcgcggccactggcatcaagctgatcgccgttgacgcatccgaggacttcctgggcgccctgaaaggggtgagcgagcctgaacgcaagcgcaagatcatcggggagaagttcatccgcactttcgaaaaggcccagcgccaggtcatcgaagaggccggcaaggcggggaaggaagtcaagttcctggtgcagggcaccctctacccggacgtggtcgaatccggcggcggggatggggctgccaacatcaagtcccaccacaatgtgggcggtctgcccaaagacatccacttcgagctgattgagccattgcgcaccctcttcaaggatgaggtgcgcgccatcggcagccagctgggcctgcctgacgagatcgtctggcggcagcccttccccggccccgggctgggcatccgcatcatcggcgaaatcacacgcccccgcctggacctgctccgggaggcggatgcgatcgcccgcgaggagctgtccgccgccggtctggacagggacatctggcagtgcccggtcgtgctcctggctgacgtgcactcggtgggcgtccagggcgatgagcgcacttacgggtcgccggtcgtgctgcgcccggtttcctccgaggacgcgatgaccgcggactggtcgcgcctgccttacgatgtgctcgcccgcatctccaccaggatcaccaacgaatgcccgggcgtcaaccgcgtggtcctggacgtcacctccaagccgccggcaaccatcgagtgggagtaatgaaagcttcgcttcaaaggtggcttgcgcaggttcatgcttgtgcgcaaatgagaaccattgcaggtttgcccacgcccgtcaatgatttgaaatcaagctaatggatcagccccggaacccaagaggtccggggcttttccgcgtcccaagatcggcgccttaacttcgagaattggcgctaaaacaaacaaatcagacccggcagcagtccgcaagtgaagaagctcggattacacccgactggttttgtcgctggccttcttgagagcctttgacagctcggtattgctgcgcgaataatatttcaggctgcgcttcagaagcttaagcatcttcctcgagctgatccttcccggttgcatcatccgagtcgtctgacggatcatcaggtggaacattgcgtttgatttcctcgatttgtgcctgcagatttatcatgtgcatgttcagcgtggtatttattccccctaccgaagtcagatcaccgtatcgtttaatcagcacctcctcacagaaggcaggcagttttgcgcactcgtcgtgcacgaaatgtccatttgtcgtgaagaccaaggacgtggcggcagttattcctgtttttcctcctacgacccccagcaaagctccgctaccggcgatgagcgcagttccgccagccatccctagaccaccggaggcaattgcacccccaccaagaaaggcgaggctggcgttcgtgagtaccgctccggaaagggcaactgtctccgcccccaatgcggctgcgagtgcgggtgccagtacaggagcgagatagaaggcaacaccgcctgcggcgactccgatggccagggttccagcagatcccgtacgcccccatagcatgcgtaaggtcgccacggtatgccgcctggtttcatctgaggtcattcgcatcgtgatagctgtaaaattcgccctcgtcacctatccgttcatccctgaacgaatacacgtctccacgtcaccacagccgcggagctgcgcccacaacccctcaaacgatcgcgcacatgtgagccgccgctccctataaggcgcttccttcaatcggcgcgtctcagcaatcagaggaagtcgcaatcgaccttaacctcttgaaacccacggatgcaagaagggtacctgcttgcaacttctcgtaaatcatttcccagctgatgattcgccttatggcggagcaagcgcgcctataatcgcccgcttccatggcggcgttaaaggccttctctacaatctccccattgatgccggccgcctccgcgatccagagaagcgacgccggattcatgagcctgttgtagcaccgtttggcgctcatgttaggttttatgcgcgtatatgagccgctgcccttggttgagttgcagcgaaaccaggcaaccatgtgctcgcgctcggtcctgcctgttttgttgggcgagtcatgcacttcggcaatatagcggtcggagtatgggtaatgatcgctcttgcgggcgaatatcctcgccgctctcgcacagcgcatatcgctcttatccaacagcacggccccttccttttacaggcgcattcgcattgcgtttattataggtacgccgcttaagcgattccgtgtcaggcaatcgcgatggaggaatgtaccccattgatcagggtcttattacattcgagccacggaaagcggcgcttaggcgagaaaagcaagcgtcagagcttcagctttatgattggttatacggtgattacgattttcgctgccaagcacgcgaatatgagcctcccttagccccaacatatcgcggacttggttttctatcgcgcgtcctacaaggaactccatccatacgagtggatcaatccatgtgaatatggcgagaataacagcaaagcacccacgcctgctattcagcgcattttcgatgaattcgtggcatagtgcgcgaataatgccgggctctcgattcgggggagggggcgtcccttaggactggcttgacttcaagccccttaaagcgcttatgctgcttggaaggccgccaaacgttggcggtggaggaaagagacggaatgagagcagcacgttttattgagccgggccaggtgcgtctggacgaggttgacgatccggtcatcgagaagccgggtgacgcgattatccgtattgtgcgcgcctgcgtgtgcgggtcggacctgtggtggttcagggggctgtccaagcggcagcccggcacgctggtgggccacgaggccatcggcgtggtcgaagcggtgggccagcaggtcacccatatccatgaggaagacttcgtgatcgcccccttcacgcatggttgcgggcactgcccggcttgcgttgccggattcgacggcaactgcatgaaccaggagcccggtggcaatggaggctaccagggcgaacgactgcgcttctccaacgcggactgggcgctcatcaagatcccaggtgcccccgccgactacagcgacggcatgctcaactccttgctgaccctggccgacgtgatggcgaccggctatcatgccgcggtcacggctgaagtaagccgcggcgacacggtcgtggtgttcggcgatggggcggtagggctgtgcggggtgatcgccgcgaagctgcggggggccgagcgcatcatagcgatgagcaggcacgctgaccgccaggcgttggcccgggagttcggggccaccgatattctgccccagcgcggtgatgaagccgtcgaggcgattcgtgcgctgagcgatggcgcgggcgccgacgcggtgctcgaatgcgtgggcagcgagcagtccgtggcttccgcgctcggggccgccaagccaggtgccgtggtgggcagggtcggagtgcctcaggactccaccgtcaacaccgctggtctcttctggcgcaatgtaggtgttcgtggtggagtggccgccgtaaccagctacgacaaggcccagctcttggatgcggttctcgacggacgaatccaaccaggcaaggtcttcacccaacgcttcgacttggagcatatccagcaggcatacgaggcgatggaccagcgcaaggctgtaaaatccctgctcgtcgtcagcgacgagtgaggtgggggacaggcgaaaaggaaggtcaatgacagcggtattgataataggagcgacgggcacggtcggcgccgcgagcaggaagcgtctgcttgagggcacgagcgacaggctgaccctgatggctcggcacactcgatcccttcagccaatcgacgccagccgagagcgcatcgtgagcggttcggtcacagaccccgagctgctggaaggcgcgctcaaaggacaggacgccgtcttggcggcgctgagtggggacctgacctcgatggcgcactccctggtggagggaatggaccaggcgggcgtcaagcgcctcatcttcatctcgtcgatgggcatctacgacgagattccggattcggtcggtgcttcggggaacctgtcgaagaaccctatcctgcgcgattaccggcaagcagctgatctggtggagggctccgacctggactatacggtcatcaggccgggctggttcatcggcggcgatgacccggactaccaaatcacccacaagggtgagccttttggcggtcacgacgtgtgcgtgtccagcatcgctgacctggtggcccgtttgattcacgagcccggcctggggcaccgggagagcttaggcatcaacaagaagccctgacaagcaccgccgggcggacggtaagggcccgcttagaggtcttcggcgtggaccatcatccagtcaaaggcccgggcgggcaggagggcgtggagggccaccaaaggcttggctccaaaacccagtgtgtagcgggctcgcggacgcttgaccgtggctgcgtggaccaaggtgcgggcgacggcctctggtttggttatcagggcgctcgcgtagagtttgcgcagaccggcggctgcccgggaagcctgctggctgtatggtccatggctggcggcggcttggaggtggtcagcggcgatcgggccccattgggtggcgaccgcacctggctcaacgaccactacgtcgattccgaaaccccgggtttccatccgcagggcgtcgctgaaagcttccagcgcgtatttcgtagcgtgataccaggcgcccatgtaggtgaccatccgcccggccatcgacgaggtgttcacgacgcggcctcgtccagccgcccgcatgccaggcaagaccagctgggtcagtcgggccaggccgaagaggttgacttcgaactgccgccggacctcctcgatcggcacctgctcgactggcccataggagccatagccagcgttgttgattaaaacatcgatgctgccctcacgctccaggatcgcttgggcaccggcctcgatcgaagcctggtcgctcatgtccatgcgtacgggcaccacgcccaggactctaagcccttccaacagttcgatccgtcggccggcgccatagacctcgtacccgcgctcggccagcatccgcgccgtagcgaggccgattccgctggtagccccggtgatcagcaccacgcttcgagacatgccacgcccccttgtgtccctgcaactgagtcttctccgttatatatccaaccagcttattgcgcccgttcgccccccccctcccaagagcgattccgcaggcggcaatcgcgcttccggcatcgttaaagggttcgtcatagccttcccgccctaacccattgagattgcccttgccggttatctccgtgatgatgtcctgtggtgcgacacgctgctcaaagatcgcttaagcgggtcaatatcggtcggcccggaaccagggcggatgtcgccctattggcttccaggatcaatgcgcgagcatgatgcctcgattcatcgaccatgcatcggcagcttgaatcctctggtcttggatcagccgccatcttctacactgtggctctagtcccggccgtctcctacgggttcgaagagcgtgctgcccctgggagcggggttggccagcatgacttgtggggcgtggtcgctggaggctatgcagaaggtgaattccacgttgctggcgaccccccaccggcccctgttgtccagagcgatcagggagcaagcgccggccttgccatagcggcggcgcagcttggcgataaaggggtagacggcccggtcgcaggcctcctgggggctggcgccttcggccatctgccgcacgatttcgtaggagaggcagcccttcatgatgtcctcgcccagaccggtcgcggccgcgcccccaacctcgctatccacgtagtagcccgatccggacagagctgaatcgcctatccgacctggccgcttcatgaagagtcctgaggtggaggtggcggcggccatcgacccggagcccgacagggtgagtgccccgaccgtgtcgtgcccgtcgtagggtgtgatcagaccgcggtccacctggtccttgcgctcgcgccatgtggattccgcctgttgggtgagcatcgatggcacggacaggccctgctcgcgggcgaagttggaggcgccttcgcctaccaggaaggagttgacatgttgccggctcaaggcacgcgcgacgctgaccgcatgcatgacgccccggatgccagccacggccccttgggctagcgtgtcgccatccatgaaagccgcgtcgcattccacaacgccctggtcgttggggagtccgccgtagcctacggaagtgtatgccgggtcggcctccacggttttgatcagctcttcgagcgcgtcagccgctgcgccttgcttccgtagtatttccgcggccttgcctacgccaccgtaggccatctgccaagtcgcaatcgtcgcccaggtcattgcccctccgctcgcccgtaagcaatttgccggcggttttgccgacttgttccaacacatcatacaagaccaatcgcagcgcgcccgctcatcaggccgtccgcatgatggacggacggtttgacacattccgctgatagggtaagctaaaacccacgtttactttttgaggagggtttgttatggcacatctgtcaatgtcaaccctgtctcgatttagctattggtggcgcagactgattctgtagccccaggcttcaagtgaacgggcgcacagatcagcggcgaatctgactgtgcggtctcgctctaaacctttggcgattgttaccccccgcagccggagaagctgcggggtttttcgtaaacaacggacggaggcaatacaaccatgagcacagtggagatgaacgaacgggtcagagcccagaagcccagcgacatactggggttcaacgccgagatcagcgcgattgatgggattgtgaaactgacgctcggggagcctgacttcccgacgccggagcacgtgaaggaagctgcgatccggtccattcaggccaacgagtcccactacacgcctagccggggcctgcctcaactgcggcaggcggccgctgacttcctggaagccaagtacgggacccggtacgatccggacacgcaaatcctggtcaccgccggtgcgaccggaggaatttactccacccttaccgccatcctgaaccctggtgacacggtcttcattcccactccgatcttccctctctacataccgatcacccaactggccggaggctcagtcgttttcatcgacacttccgacgacggcttcatcctgacgccggccaagttggaggccgccattcaagagcaccctgatacggcaaaggccctggtcctgaacttcccgaccaaccccacaggcgtgacctacaaccgtgagcaactccagggcctagcccaggtggctcgcgcccatgggctgctcgtcctatccgacgagatttactccgaattgacctacgaaggcacccacgtgtcaatggggcaagtcatgcctgagcgcacgattgtgctcaacggtgtgtccaagtcccatgcgatgactggctggcgaatcggcctggcggctgggccggccgacctgattgagcaaatcggcaaggtcagcgaattctcaatcacctgcgccaccgccaacgcccagtacgcggcccttgaagccctggggcacggacaggacgacgccgaacctatgcgtcaggcttaccgtgagcgcagggacttcctggtcccggcactgcgccaggcgggtctggagtccaccgacccgcaaggggccttctatctgtttgtcaagctgcccgagcgaatgaaggactcctggaagttcgcttattccctggcccgcgaagccggggtggcggtcatcccgggggccagctttggtcccggcggggatggatacgtgcgtatctcctacgcggcttcgatggaagacttgcgaacggcgacggagcgaatcgcggcctatatgcgcgcccactgacaggcggccgtccaggggggggggagacaaggcctctggggttcatgaaatgtagtgcaagaacggtagagcggtaaaggaagaaaggtaatcatgccgaaaattctgatgtactcggtgaggcccgacgagatgcccgtcattgaggcgtggtcccaagccaatcgcatccaggtggacacgaacgaggtggagttcaacgcttccacagtggacctggtcaaaggctacgacggcctggtcattcagcagcatggctcgattggtgggccggaggtttatgccaagctcaaggcttacggcctgcggcagattggcctgcgcatcaccggatacgacatcatcgacctggaccaggcacgtgcgaatggcctggtagtgactaacgtcccggcctactcgccccgttcggtggcggagttggtcctggcgcacgtcatgcgcctggtccggcacctgggcgagtcaacggcccggcaggaacgcggtgacttctcctggaccggtcttgaggcccatgagattcacaacatgaccatcggcatcatcggcgctggcaagatcggctcaaccgtggcccgcatcttcaaggccctgggcgccaccgtaatcgccaacgaccccatccaccggcccgaactggccgatgcgctggactacgtcggcttggacgaactgttgatgcgctcggatgtcgtcaccgtccatacgcccctggaccagagcacccatcatctgatcgacgcggatgccctagccaagatgaagtccacggccttcctgatcgacgctgcgcgcggacccatcgtcgacacgaaggccttgatcgaggctctcaaatccggtggaatcgccggagccgcgatggattcagtcgaaggcgaggctggcatcttcggtgaggatcgctccgccgaaggctacgataaccccgatttgaggaccttggaggctatggataacgtagaagtctcaccgcacatcggtttctacactgacgcggcggtcaagaacatggtcgaaatcgctctggatgacgtcaaaaccatcctgtccgggggaatcagcgaacaccaggtcgactgatcgcagacggcggccgggcctgttccggtcgccgcccgccccatcaacaactccagctcccaatgtaaccccgagccgtccgcagccgcggaccctatggaaagacaaccagtatgaacaccacaagcgtgagcccggccacctccgacggtccaacgccagcatccagcataaaggccactaacagccaagaaaccccgaccccggcccaggattcgttctcgaccaaggccaaggccatgatcatggacatcctgaacggcttgtcaaccggtatcatcgtggccctggtgcccggagcactgctgaacgccctggtcaagtacctcctgccggtcgcgccctggctgcgaccgattccgaccatgaccggcatggcccaggtcctcctgccggctgtcagtgccgtgtgcgtggggatgatcgccaagttcacccccatccagacctcctccttggccctggccgccgccctcggagccggcaattggaaagtctctggcaaagggttggccctggccggccctggggacgtgatcaacttggctgtgaccatagctgtagggtatctggtgctcaaactacttggcgacatgctcaagacctatacgatcctcttgctgccgacgctggtgatcctgatcgcgggcggcatcgggatgcttacctacgggccggtctcctcgctaacccgctgggtcggcgcaggcgtgaacgccttgacctccttccagccggtgcctatgggcgtgctgatgggcgcggccttcgctctgattatcgtcagcccgatctcctcggtcggcatcgccgccgcgataggcgtgaccggcatcgctgcgggttcggcgaacctgggaatcacagcggcggccctggctctggccatttacgggcgtgaaaccaactccgtgggcaccagcctggcccatttcctgggatcgcccaagattcaaatggccaatttgctctcgcggcccaagctcctgctgcccttgacgatcaacgccgcgatcatgggtggtgtcggcgcggcctgtgggatccagggtacccccgcttcagctggtttcggcctgtcgggattgatcggccccctggccgcgatcgaggcccaaggaggcttcaccacagcccatgtcctggaagcggccctgctcttcgcgatcctgcccgtagccctgggctacttaagcgacctgattttcacccggctcctggactaccagaagcccgaatactacgcaatcacctactcctgatcgccgcgaccccaccaaccgttaggatgggtggggtcggacagcgggggagcgccccgctctaaagggaggggcgagccctatgagcaaaccggacgagtacgacttcaccagcctggtggaccgcagggggactaattcctacaagtgggacgtggctaccggcgagctgccgatgtgggtggcggacatggacttccgcacggctccggagatcatcaatgccatgcgccggaagctggaccagggcgtcttcggctatgaggaggtgtccgagagctactaccaggctgtggccgactggtacggccgcgagcatggggcgcgtccttgcactgagtggatgctcttcgtcaacggtgttgtgcctgcgctctcctcgctggtgcgccgcctgactcagccgggcgatcaagtgttggttcaggctccggtctatgacatcttcttccattcgatcgagaacaacggccggcacgtgctttcgagtgacctggtctacgaccccggcagccaccgctaccatgtcgacgagcaggacttggaggccaagctggccgaacccttgaccaggatgatgatcctgtgcaaccctcacaacccagctggcaaggtgtggtcccgccaggagttggagcgcacagcgagcctgtgcgaacgtcatggggtgagcctggtcagcgacgagatccacggtgacctggtcttcggccagccccagtacacccccctgttcgctttgcctcctgaactcctgggacacgcggtcagccttgtttccccatccaaaagcttcaacctggccgccctgcacgcggccacgatcgtcgctccgggcgagcgcatgcgcgagtcgatcagccggggcatcaacaacgacgagctggctgagcccaatctcctggcggtgccgggcacaatcgccgcctatgaggaggcgggcccctggctgcatgccctcttaggtcagctggaacgcagccgctctcgggccgtcgcctgcctcgaaggcatcgacggggtcgaggcggccaacgagaacgctacctacctgctctggatggatatcagcgccctgggggcgaaagccgatcaggtggccgccttcatccgtgaggacactggcctctacctatccagcggatcaatctatagggggaatggggaccacttcctgcggatgaacttggcttgcccgcccagtgagctggaggacggcctggagcgcctggccaggggagtgcgcgacttccgggccaggcggtaagcggattcggctggttctttcactcgctctcagcgaagcgaatttcgccggtttcagggtccatgccctccacgatagccagggactttaagtcatagccctcttcgcgtagtttgcggccgccttcctggaagcctttctcaattgcgattcctatgccttcgaccttagcgcccgcgtgctggcagatgtcgatcaggccgtgcagggcgttgcccttggcgaggaagtcgtcgatcagcaggacgtgatcgccggcatggaggaagcgttttgccacgatgaccgggtactcacgctgtttggtgaacgaatagatggaggagacgtattggtcgccatccaggttgatggactgggtcttcttagcgaacacgaccggtacgtcgccaaagtgacgggcggctaggcaggcgatgccgatgcccgaggcctcgatggtgaggattttgtcaatctggcggcctgcgaacaggcgggcccattcggcgcccattgcatcgaagagggccacgtcgcactggtggttcaggaaggcatccactttgagcacgttacccggcttgactgtgccgtcatgacgaatgcgttcctctaattgcttcatagcagtccttatagttggtaggcggacggaaggtcaagagccgtccctggaggggcgctgctcgatggaaccagcataaccttccagcatgacctgcgccggttgggccccggctagcgtgaggatgccggaaagaccgaaaacaaccgattttcgggcatagcactggtacaataaaagagaattaagcgatcacgtgccacgaggtgcgtgtgtctggaaggagaaccaatgagtgtattagacaatgccaaggacgccatgaaatcagcgggcgacaaaatctccgaggcggccgattcggccaaggacaaggtgtccgaggcggctgagaccgctaaggacaaggtgtccgacgcggccgacaaggccaaggccgacgccaaggtaggaaaggccaaggctgagcagggcgcgaccgagatgaagaatgacgcgaaggacaagatgcgcaactagcgcgaaccgctgtgcgttcatcgccccgggaggttgatagcccccggggcgcttctttgcgtgcgtgcgggcagccccatgaccgtcgtgtgtgctacaaatgagaactcggcggccgtcggtcggtccggccggtgttgacagaggcaagcgcgtattgaggggttgcaagtgtttgaagatcctgatctggtccaacggtccgccgatgagctcctggctgggctcaacccccagcaggcggaggcggtccaataccgtggaccggccttactgatcggggccggcgcgggttcgggcaaaacccgcgtgctgacccggcgaatcgcctggattctcagtcagttcggagcttggccaagccaggtcctcgccatcactttcaccaacaaggcggcctcggagatgcgcgagcgcttggggcagctaatcgggccggtggcccagcgtatgtgggtatccaccttccactcagcgtgcgtgcgaatcctgcgccgggacggccgtgagatcggactcaagtccggtttttcgatatacgattcggctgactccgaacgcctgatcaagctgatcggccacgacctgaacgtggacctgaaacgcttcacgccccgttcgatcctgagtcatatctccgattgcaagaacagcctggagacctggcaggagcggctcaaggagttcgctcccgattatcggccgggtcagcgcggccagttcacagcccgcttcggcaatgaggaagagctctacgcaatcttctacgccgagtacgagcaccggctggccctggctaacgcggtcgacttcgacgatttaatcgtgcgcacggtcgatctcctacgttcggcgccactggtggcccagtactaccggcataagttccgctacatcctggtcgacgagtaccaggacaccaaccatgcccaatatgtgctcctgcgggagttggctggggtggatgacgccggggatgcgcggacccaggggccagggccgtccgggtccaggcctgtggccgccggtaaggatgggccggcctggattaccgtcgtcggcgactctgaccagtccatctacgctttccgcggggccgacatcagcaacatccgcgacttcgagaaggacttccccggagccaagaccatcatgctggagcagaactaccgctccacgcagaccattttggacgccgcgaacgcggtgatttccaagaacacctcccgtcggcccaagaagctgtggacggccctgggtgaaggtgatccgattgtcgggtacgcggccgacaacgcccagcaggaggcggcctggatagcgaccgagacggcccgcctgcgcgctgaggaaggcgtcccttactcggatatggcgatcatgtaccgggccaacgcccaatcccgtccccttgaggaggccctgatcaacgcggggctgccctaccagctggtcggtggcaccaagttttacgagcgtcgtgaggtcaaggatgccctggcgtatttgcaggcgatcgccaaccctgacgacgatgtgaacctacgccgaatcatgaacgtgcctaagcgcggtctgggaccaagagccgaggctctggtctcgatgtacgccgacgcccatgcgtccagcttctggtcgggcatcgagcattacgagtcgattgaaggcctgccgacgctgaccgctaaaaagttggaggctttccgcgcgatcatgcgcgagctgactgcattcgcggccgaacacgactccaagccctcgcaaatcgtggcggaggtcctcgaagtctccggcctgcttcctgagctgcgtaagtctgtggacccccaggacgcctcccgggtcgagaacctctctcagttgcagtccgtggctgctgagttcgaacagaaaacgcccgatgcgacccttgcaggcttcctggagaccacggccttggtcgccgactccgaccaactgccgggcgaaggggaggagaccggcaaactcacactcatgaccctgcacaccgccaaaggcctggaataccctgtggtctttctgaccggtatggaacaggggaccttcccgcactcacgcagcctggaggacgtcagcgagatggaggaggagcgacggctcgcctacgtgggcatcacccgcgccaagcgacggctctacctgacccgggcgtcggttcgcgcccagtgggggcaagccaacgaaatgctccccagccagttcctggacgatatccctgagagcttgattgactggaagcgcaagcagtccgccgtcgagcgcatgcggggaggttgggagcgggacggcgaggacgacgaattcggaggtttcgaggacggcgctttcacctcgtcctccgtttacggttcgtctcgtgggtcgtcatccactggcggctcctacggctcgtacgggtcgggttcgtatggttcccgtggcgctcgcggctcgcagggcgggcattcgggcagtggctactacggctccggcaggtcaacgggatcacggggctcctacggctctggccgtgcccacgggtcgtcaggctcctccaaggcgtggtcccaaagcgggcgggtgaccaccagaaggaccaagcccacgaggtcgtcccaggcggggtcggcccaaccctccggctccaagctctcaatcgacgacttccaccggggagacaaggtcgctcacgatcagtacggtttgggcaccgtcgtcgatgtgcaggacaaaggccataattcggtgctgaccgtggatttcggctccgatggcgttaagcgactcatgctgcgggtcgctccaatcgagaagctctgagcggagactgccctagtccgacaaggaatggccatacggaaaggcccccgaccatggcgtgatggtcgggggcctttcatgtgcttcaaaacgcctcggcaagccggctggaatcagtgggctgcctttcgcttcaggagcacggcgcctcctgcggccaggcacagtccaaggcctacggctgcgacaccgaaaacgctggcaccagtacgcgccaagcccagttggccgctccggctgctgagtggatcacgtgagccggaagtcgagcctccagggttgctgggggaggcggaaccgggagcgctgggggcacctggtgcgccgccagagttggaggacgaaccatgttggttgggctggttgggctgaggaggggagctcaaggattgaatcctggctgcgatgtcatcgtaggtcttctgcgcggcgttcacggcctcttgggcggcgttgacgtttgcgccggcgttcgacaggaatgaccggtaggactggaagttcgcgtagtagtcctggaccgtcatcgaccgcgatccagcccaggcgttggcggagcgcaccatgcgcggggtcaagccgaagaagaatacctggccataggtgtttccaccgtaggggttggaggaattcctgtgaatcgcgaagccggtgatttggtaggaaccgttgacgatgttgtcatagtggccggttatgccgttgccgttggtcttattctgcttttctgccgtataccacctggcgaaggggtcgttttccgggctgttccaggccaggttctcgccgatgtcgaataccctcgcgtgttcggtgttggtcgacgaccagtcagtatccgcctgggacatagccatcagggtgtctgagaccttgagagcgcctttgccttccccggcccgcagttcgttgcacttgtcgaggtattcaaacgtggcgcccatattatccaatgaggtggcgtcgtcggatgcacccaggtggatgctggggccgagcttgccgttcaaaccgctgtcggtcaggacatcataggctcctgtggctccgacgtatttgaagtagcctgcggttccttcttccttcagcgctgtggcttgagaggccatatcctgcttggtcttgagattggccttggcttcgtccaggttggtggaggccgcggccagctgctccttgagctgcttgagctcagcggtgtcatcggccaatgcggggctcgccgcaccgagggcgacggcgcctgacacggccaccgtcagtcccagcttgatcagccgggcaatccaatcattcgctgcatgcatattagtatttcctcgttctctctccgcgcccgtagctacgcgactgtgcatggctaagcgagcctatcagctcttccctacccagcatcgtacctaaaagcgagccccgaacacaagacaggcttgcgctaggcccagggatagcgggtgaagctaatccttgcccttggaagagacgatgaagtgctcctccgaaggcagggccaggttggcgatgacggcgacgacaaaggcgaccgctatgcagttggtggagaagatggattggaagagcggtgggaaggccgcgaaaatctcatggacctgcgtgaagccgatacctacagtgagggataaggccgcgatggtgatgttgcgttgggagaaaccggcttcggcgatcatctggaagccggagaggatgatgttgccgaacatcatgattgtgcaaccgcccaggacggcctggggcaaggagttgaagactgctgcgatgccgggcacgaacgaggccaggaccagcaggagtccgcctgagaagatgaccttgcggttgacgactttggtcatggccaccaggccgatgttctgggcgaaggaggtcagcggcaggcagccgaagaagccggagacgatagagatggcgccgtcgcccgcgatggcgccgctcatctcgcggtcgctgggcgtgcggtccaggcccacccggcacagggcggtcgtgtcgccgatcacctcgactgaggagacgacgtagagcagggcgaaggagatgatggctccggcgtcgaactcaggtttgaaaggcatgactcgaggcagggaaacgacctgaaggtgctggaaaccggaaaagttcaccatgcccatggccagcgccacggcatagccgatcaccaggccgaagaggactgaaagctgcttggccgtgcccctggtcagcagttggaaacccaggcaggccaccagggagatcgtggccagagtcaggttctgccaggagccgaagtccttggccccggctccgccaccgaaggattgcgcgcccacagagagcagggagaagccgatggaggtgacgaccacggccgagacaatgggcggcacgaagcggcgccaccagttggccgtgagccccaggatcagctccaccaggccgccgaccatgaccgcgcccacgaccacgccgtagccctggtgggagacgatggacaccgccgcggccacgtatgtaaaggagatgccggtcaccataggaaggcgcccgccgaccttccacaagggatagagctggaggcaggtgcccaagccggcgaccagcaggccgttctggatgaccatcgccgattgatcaggcggcatcttggcggctgccgccaccaggaaaatgggcgccaggttggctacgaacatggccatgacgtgctgcaagccgaagggcaggccccgccagaaggagatcttgccgttcaggctggtcaaggggctggtctggtcctgctccgggctttggatcccgccctgcgcgctgggggcggacgtccgcccccgcttggcttcgggtgcgctttcggcttgggccgcgcgctctgtgctgtctgtctgctgctggggtgtggcgctcacgcttaccttcttctcgttgttaccgcggaggtgactgcaatctggatgatggttagggcaggtaattgtgctggatttaactgactcgcattcgcccggctaagggccgaggccgcccctagccgctgcgggcggcgggtggcgctggccgggggcgcggacgcaggaaggccatgcacccgtgggatgcatggccttccgaagtattgttagccgcttggacccggactcctgcccttggatcggggctgctccgtccgctgcggcatggcagatgttgaacccgtagcagcgtcggacgacgcggggacttgtctgcatacgcctctcatctcttacggggctacctgcaagcgctgtggccgctgggcggtttggaggacaattgctgggggcgggagccgcttgcccgtacggcgaaaggctccgatacccaggagcatacttcgggccctgaccagggctgtggagccgtgtcatatggcggacgggtgcgttccacttattgagatgggccctatccgccatcgacgggcctgcgctcgcggttcaggctacgcggcgggcgaagcgggtggcgaataaggaggatgcggccatcaagacggcgatggcgagcatgagcgcaggtagaggcaagtggtcgatcagcggcccgtagagggcctggcccaggggcatggcggccatagacaggctcatcgtgacgccgatgaccttgcccaccagctgccggggcgtcgcggtctgctcgaaggagatgatggtgaccgatacgcactggaggaggcccattgcgacggtcagcgacaggaggagggtcaggtaggagacacgcgctggggcggacagtcccatgctaagggccgcgggcagcaagcacaggccgctgagggcgatcagcgccggcagcaggcgcatcgagaaccagccaggcttggtggaggtcaccaccgcgccagccagagcgcccgccgatatggcgccctccgccaggccctgcagctggttgcttaagcccagctcctgggtcacgatgtagggcagggccacgttgacgaaggcgcagaagacgagattggcgaaggttacaaggacattggccacaagcagggtacgctgcccgcccagaaagcggatcgcttgggcgaagtccgccagcaggagcctcaaggggtgactgagcgcctggcccgccttgccctcggctgagccgccggccttggcctgggcggggctgctgggggtgcgcgcagccaggaggatccaaacgctggaggccaggcaggcggcgccggccatgattacgaccgggacgatgcccgcgaagctgagcagcaccccagcgaagatggggcccagcatcgtggtcagggaggtggtttgggagatgatgccggtggcttgtgtcaagcgctcgcgctcctgtttgccgctgctgtgggtcttaccgcctggctgggcatcgccatgggggtgctcgcccaggttgacgatgaagggcacccaggcctgcacgaccggcccgtagagggcatggaagccgtaggccagcatcatcgcggcgatggtgagggccaccaggtcgaagctgcgggacaggaggaggtaggccagggagatgccggcggtcaggaagtcgagcagggccatcgtccggcgcttgtccaagcggtcggccaccgcgccgccgacgggggtcagggcgacggcggggatcagcgcgagggcgatgaccaggccatagagggaggcggagccggtcaggttgagcaggtggagggggagcgcgaaggtcagggtcacctgaccgagggaggagaggatttcagtgacgagcagggaaaggaagagcggggtgaagatgttattctgagcggcggctgtgggcttgtggttcatgggggagggtcctgttcggtgtgtcgattggtgtggctgctggtggtggatgttgtcgccagatatataccgacggttggtatttatagtttgcgagagttcattgatgatctgctggccttgtctggaggggtggggcggggccatttctatgcctggagcgggttgtgtgggagcggcggacggcggcttggacctgccgccgatgcttatcgtcgctgggacttcggccgcttcgtcggcttgccctgccgggattggcgctgccgtttcctggactggtcttcttcgctgggctggggctccgcggtctgttcggccctgcctgcatcgctgccgtaagaagcaatcaggtcggctaggccccggtcctcgacgggggctcccagggccttcatggcggtcaagtagacctccacccgcgccctgagttcctggctggaaccgctggtgaagagggggtacatccacatgttggccagcagcatctggagttccgccacctgctgggggtgtttgacctgcatggatccgtcctcgtcgccacgggcgaagaccccgctcatgacggtgcgggccgagcgcatgagtcctaggaattgcaggcctatcagcttggggttcttctcggggttgaaggagcgcatgatgggctcgatggccgccagctgcgggcctacgatggtcggatcgtgctcctcctgcaggatctccaggccgttcggcgcgtcttcgccgctggtggcgcgttttcctcgcccggcgctgagttcggtctgctcctgccagcgggccgccttctgcggactgacctgggcgaagatgcggttgacgaccgcgtcgaagaggtcctctttggaggcgaagtggtggtagatggcccccttgctcaggcctcccaggtggttgatgatgtcctgcatgctggtctcgtcgtagccttggcggatgaacaggtcggtggccacgtccagtattttctggacggtctcttccgggtgggcgttgcgggccatgatgcttccttccgtgggcctgacgggcgacacgatggtcaatccgctgtcggctgccggttgctggttttccagaggggcaagtaaccgaccgttggtatgcatcgtagcagtgggcgtccgtatatacaaactgttggtatgtatagtctgtgccggccggactttccctcagcgtgcgccggaagtactgagatcccatcggcatgcggtccggcctgtgtggcagaatgttctcttggtgtccgcgcttatgcggaaacctatctggagtctcagcccgtcaatgggtcggcggccatcggccgttcagcattggagaggcctgactcggcggcgcgagccgtctgcgttcagataacgacagaatagcgaaggaaatactatgactaacgttcagcgttcgcgtcggcaggtccgcctgtcccgcgccctgggcatcgcgctgacccccaaggcccagcgcctgttcgagaagcgcccctacgcccccggtgagcacggccgcacccgccgccgcaccgagtcggattacgccatccgcctgcgcgaaaagcagcgtctgcgggcccagtacggcgtctccgagaagcagctgcgcgctgcttacgagcgcgggaccaaggagtcgggtcagaccggcgacgccatgatgcgcgacctggagtcccgtctggacgccctggtcctgcgtgccggcatcgcccgcaccaccgcccaggcccgccagtacgtggtgcaccgccacatcatggtcgacggcaacatcgtcgatcgtccctcctaccgtgtcaagcccggccagaccatccaggtcaagcccaagagccagaccacggtgcccttccagattgccgccgagggcgttcaccgcgacgtgctccccgcggtccctggctacctggatgtggatttggcctctctgaaggccaccctgacccgtgaacccaaggtcgaggagattccggtgcaggtcaacatccagtacgtggtggagttctacgcccgctgatgtagctgttccacagacccccgcgcccaaccggcgcggggttttctcgtactcgggccctcccaatcccgtagccagccgaatcttgggcgggtcctcacgccaggccctggctcagcggcccgccagcgtgaggagctgcccaaaaatgctgggagcagggttgggggagcgcagattggcgggtaggggctggcttcgggctggttccgggcccggtgccataatgggagacatggtgctccacatatacgctgttcgtcatgggcagacttacttcaaccgctacaaccgcctccagggttggtcgaactcaccgctgacgccgtccggtttgagtgacgccgaacgcgctgggcacaagctggaggatgtggccttccaagcggcctacagctcggacacgacccgcgcccaggtgaccgcccaacgcatcatcgacctcaaccaggcttcggagcccaagcctgccttgcggtgcgcgatgaacttccgagagcagttctacggttactttgaaggtcaagacatggggatggcctggtgggcggcgggcgccccgcatggcgccaagagctaccaggagatagtggaacgctacgggctgggggcgacccgggacttcctcaaagaggcggacccctttcacgacgccgaatcggaccaggagtactggcagcgggtggaggcgggcttccgtctgctggggcgggatgagactctcgccgacggcgataaggtcctgctggtttggcatggcaactccttgttgagcttgatgcaccggttcgcccctgagggctacgacctgagcgagcggcccgccaatggctcggtcaccgtcttcgactacgaccctgaagcccccttcgaccaggcggtagaggtctcctcttacaaccaataagtcggcaagcgggtggacaaagactgcggtgtataccggcggcgtggtagccttagcgagtaaaagcgtcacccgggaaagaggttacaagatggatgtcggccagattgcaggcctgatagcggccatcgcgtttgcgattctcgcggggttcctgatttacccgctgattcgcctgggcaaactcttcgatcagattgctgacaccgttcggcagaccggcgtgcacgcgatgccagccatcgacgagtccgccaccacggttcgccaggtcaaccagtccctggaagacgtcaaccggatttcggccgcggcgtcgaccaccgccggcaacctgggcgccctgtccgacttgtatgggtccatgctgggcaagcctttgatcaagttggcagccggtatctacgccttgcgcgtgaccgccagctccttcttctccggtggcaagcggaaggccgagcgtcatgcccaagacgtcgcaggcggtgtggccggtaagcccggcaatggacggaacgagggggtctgatgctcaaacgaatcgtatgggtaggcgcaggagtcgtccttggtgtcatcgccgcttccaaggccgaggcttatgtcaaggccaacacgccacagaaggcccgcgaattcgtgcttggcccggaccaggagcatgtggcggaacggaccctggcgagcttgacctctcagttccgcgcggtcaaggacagccgcgaggccgagctcaacaaacgttacatcgaccgttcccgcagccaggggcgctgacccactagcgctgaataagcggcgccgcagcccagtaagggcttttgccatatttggacatcctcgaatcagcagggtgcaccctgcaaggagcacaacaaacccatgcgcacatctgaaatcgcgaaacgtttcctcgattacttccaggggcaggggcatctggtccaaccgtcggcttcgttgatctcaccggacccgtcgattcttttcaccatcgccggcatggtccccttcatcccctacctgatgggggagcagacaccgccctccccgcgtatggcctccaaccagaagtgcgtgcgcaccctggatatcgacgaggtaggcaagaccacccgccatggcaccttcttccaaatgctgggaaacttctccttcggtgattatttcaaggaagaggccatccattacgcatggaccctgctgaccactccccagagcgaaggcggctacggcttcgaccccgaaaagctatgggtcaccacctacaccgacgacgaggaagcccgctcaatctggaggaacgagggtttcgatcctgagcacatgcaggtcttcggtatggaggataacttctggaccaccggtggccccggccctggcggcccctgctcggagatctacgtcgaccgcggatcccagttcggcaaggacggaggccctgcggccgacgataaccgcttcatcgagatttggaacctggtcttcgagagcttccaggtggacaacgtcaagtccccaaccgacctgcatatagccggtgagctggagcacaagaacatcgacactggcgccggactggagcgtctggcctacctgttgcaaggcaagcaaaacatttacgagaccgacgaggtcttcccggtcatccaagcggcgggcaagatcagcggccacgagtacgggcaggacgaggaagccgatgtgcgcctgcgcgtggtggccgaccatgtgcgttcagccttgatgatcatgagcgacggcgtccgcccctcgaacgtgggccgcggctacgtgctgcgccgcctcctgcgccgcacagtgcgctccatgcgcatgctaggcgtcgacgaaccggtccttcccttgctcttcccggtctccaaggaggccatggcgccctcctacccggagctcaactccaccttcagggaggtgtctgaggccgcgtacggcgaggaggacgccttccgtcgcaccttggtcaaggggaccacgatcttggacatggccgtgagcaaggccaaggccgcccaggattccaccgtctcaggcgaggatgccttcaccctgcacgacacctatgggttccccatcgaattgactttggagatggcccaggagcagggcgtcaaggtggacgaggccaagttccgggagcttatgcaggagcagaagtcccgggcccgtgccgacgccctgcagaagcgccacaatgtggacctgtcggtctatgacgatatgaagaaggaactgacccagccgatcgagttcctgggctacaccgacttcacctcccgctcccgggtgattggcatcatccaagaaggcaagggagcagtgccggcggccacggcgccggcttcgctggaagtgattctggaccgcacccccttctacgcggaggctgggggccagttggccgatcagggcgagatcctgtccgacgatggggccgtcctggaagtggacgacgtccagaagccggtcaaggggttgatcgcccaccgttgccggctgacggaaggcaccctgaccctggacgctcaagtgaccgctacgattgaccccgacaggcgcggggccatcgcccgctcccacaccgccacgcatatggtccacaaggccctgcgcgaggagctgggtccccaggccacccagcgcggttccgaggatgccccgaaccgtttgcgcttcgacttccagtggcccaaggccccgtcgcacgaggccatggatgcagtcgaggcccgggtcaatgaccgtctgcgcgacgatttgacggtcaccaccaaagagatgaaatacgacgacgctatcgctttgggcgctctgcacttgttcggcgagaagtacggcgatgtggtccgtgtggtcacaatcggagaggatgggtggtcccgggagctgtgcggtgggacccacgtggatcgtgtgggcaaaatcggccaggtctcgattatgtccgaagcctcggtcggcaccggtgtgcggcgcgttgacgcggtcgtggggcagggcgcgtacgagtacaatgcgcgtgagcacgccctggtctcccaactctccgacaagttgggcgccaggcctgacgagctggccgagcgtgtctccgccctactggccaagttcaaggaatccgaccgtcgcctggctcgcatgtacgaggatcagcttgcaggtgccgtgcccgccttggtgaagcaggcccagaggtcggcggccccggtcaaattggccgtcgggaatgtagggcacttcggatcggtcgatgccctccgcaagaccgccgctgatgttcgggctcagatcggggaccaagagcctgtggtcgtggccctggcgggtgtgaacgaagagggcaagcccatcattgtggcggccaccaacgagctcgccaggaagcggggcatcaaggccggcgacctggtgcgcagtgcttccaagaccctaggcggtggtggtgggggcaagcctgacttcgcccagggcggcggccaggacgccagcaagatcgaccaggccctgcaagccttgaacgggcaggcgctgggcgcctgaaggtagtagcgatgagccggaagcgatggatgggcgtggacttgggcgaggcgcgagttggcctggccctgtccgaccccgagctcacactggcccaccccgcgggcaatatcgaagtggctggcgactacttccaggccctggatgaagtgatagctcaggtggaggaggcgcaagccacccgcctgattatcggttaccccctgctcctgagcgggcaggagggccggtcggctaaaaaagccaagcgttgggtccatgccctacaagggcggatggatgagtacgccagcagtgggcagctagcggtagaaccgcctgagctggtcctgcgcgatgagcgcctgaccacggtcagcgctcacaggcagttgtcccaagccggtttggatggacgactgcaccgccccaaggtggatcagcaatccgcggtcgtattgctgcaagccgccctggatgagcacgcggaagcgacaaggagcgatattggctgacgacatgagtgacttcttcgcaagcaaggcgcaatgggtgggcggcggcgaccccatccctgctcctgtgccaccgcctccccccgcctcccgccggcaggcgcgacagaaccgaaagcgcgacaggcgcagacgcaaggcccggctgttcgtggccctagcggccgtggtcgtcgtcgttgtctgcgtcgtcaccggagtcaactacatccaccatgcccccgcgaggatcgaaccgaccaagagcgtggcggccgactggccagggccagggaacgacccggtggagttctcggtcgaatccggccagggcgccgacgaaatcgcacgcaacctggtcacggctggagtggtcaaatcgccagacgccttcctgcaagccttggctaacgccggatcgtcctcgtcgattcaacctggcaccttccaactgaggacccacatgaaagcggccgatgccgccgcgatcctgaccgatcccaagcaggccggcggattcctccaggtacgcgccggcgaccggtcccgggatgtgattgaacgggccgcccaaatcagcggggtcagcaagtccgacttcgaccagatcatcgcggctcagggccaaggcatcctgccccaggaggccgcaggcagcttcgagggctggctcgagcctggggcctacgacgtgaaaaagctgaaatccgcccaagagatcctcaagaccatggtcgacaagcgcgtcgcgaaactgaacgccctcggggtgcctcagggggcggacagggagcgggtcctcaacatagcctcgatcaccgaggccgaggtcaacaagcctgagtactacggcaaggtggcccgcgtgatcgataaccgcctgggcaccggcatgagcctgggcatggactccaccgtggcatacagcaagaacgtttcggcgcttaagctgaccaacgacatgctcaacgacacctccgacccctacaacacccgcgtgcatccgggcctgccgcccacgccgatcggcaacgccggtgacgcggccatccaagcggccatgaatcctgaggcgggcaattggctctacttcgtgacggtcaacatggacacgggggagaccaagttcaccgattcctccagcgaattcgatgggttcgccagggaatacaaggagtgggagtcccaccacaacggctgaaatagcctcagccgggagctcaagggttgcagaccaggccgctagagagcccagaaccaggacagcaggtcggccaggagcgccgctgccgcgatgacggccacgaacggcaggccccgcccacggtcagtttcgcctcggctggtccttccggcctgccagcgggtgtggaaggccagggcggtcagcccgatcagtcccatcaccagccaccagagcagggccgtccgccagcccaagacacccaaagccaggccgctcaaagcagtggcggtcacgtcacccaagcctagggagccgggcttggccaaggccatcgcggtctgtagcaaggtcgaagccaggcccacggaaatggccaggatcaccggccatagctccttgctcccaatcgcgcagtagacgatcaaggcgagcagttggatgaggacacctgccaggacgcccaggcgcggcacccgcctggagcgcacatcctcgacagcgagggcgcaggccactatcagaccgggcaatggaacaaggtagaccatcttctaagatatacaacaataaacgggcggagacaaaaggagagtccatgttgcgtcggcaaagctcgggggagccgcacaagccgtcaagggaaccaaggcctgatgcggacggatcaaggttcgtccgcgtcttctgggatgccgtaagcgtggccgcgagcccgcggtccccactggggactcacaggtgagcgtggagggcgccggccccaaagccgtgatcatcggaatgccgggctcaggtaagacgcaagttggacggctggcagccactatcaccgacttgcccttcaaggactcggaccatgaagtcgagcgccgggcgggtcgctcgatcgccaacatcatcgagcaggacggggagccgcgcttccgccgcgtcgaacggcaggtggtctgccgactgctcaagagcttcgacggtggtctgttggccttgagcggaggttcgccgatgacgacggacatctacgaggaactgatggattaccgtggccgcggcggttgcatcatctacctggacgccgaccctcaagaggccagcgcccgtgtggcgcgcaactccaggcgctccctcctggcgcgagacccgcatgagcgttggaagcagctccaccatgagcgtgcccctatatacgagagcttggccacaaccaccttaccatcccacggcagcactcccgaggccatggcccagtccctggccgaagccctgtacgagcgggtggtccacatctccggagcccacccctacgatgtgcgtatagggccgggcgtcagctcccgtctgcgtttcctgctggggtcacaggcggttcgggtggcgctcattcacacccgttcggtccagcggcacgccgaccatgcccgcgccctcctgcgtcaggcgggctaccgggtcagcgagattacaatcccggacgcggaggccggcaagaccttgcaggtcgcggacaagacctgggatcgcttggcccaggatggcttcacccgttccgacgcggtcgtcggcgtgggcgggggagcagtggctgatctggctgggttcgtcgccgcctcttggatgcagggcatcgcctacgtcaactgccccacttcactgctggctatggtggatgcctcggctggcggcaaaagcgcgataaacacggctcatggcaagaacctcatcggcgccttccgcgcgcccgagggcgtcttggctgatttgaagaccctgaagaccctgccccgcgaagcctttgttgaaggattgggcgagacggccaagtgcgggttcatcatggatcgctcgatcctgagcctgctggatgaccatgccgaccagttgcgggcattcaccggcgaggagcccgcttcatggattgaagcggtgcctgctgagctgatagaacgctcggcgacggtcaaagccagatatgtctcggtggatatggacgagacgggtccgcgcgaattcctcagttacgggcacacattgggccatgcgatcgaacaggtggagcattacacctggcggcacgggcaggccgtggccgtgggcatggtcttcgccgctgagctctcgcgcatcttgggccgctgcgaccaggaactggtggacctccaccgtgagctcttgggtcgtctggggctcaagaccgcatggtcgggaggcccctgggagaaggtcttggacgctatgcgccgtgataagaaggcccggggggatcggctgcggttcgtcatcctggagggggtgggccgcccggtccacctggatgatccgcccgagcaggccttgcgggaggctttcgaacggatacaagagtaggcgcccacccggctgtggtcggtcctgccggcgcatgtcgggtgagcggcgtaaggcgaagtgcatgagggggctggtgattcaggccgaacggcccattgcgcttcgcccccgggtcgcggcagcgtcacaggcgagggaggggtagcgagaatggtacgagcggaaaaggccatgagcggggcggggaggggtccacaaccgccgcaggcgattgaggtggagggggccagggtccacaacctgcgcaaggtcaatgtacgggtgcccctgaaccgtctggtcggcatcgctggcgtctccggctccggcaagtcctccctggcgcttggtgtgctctacgccgaggggtcgcggcggtacctggacgctctctcgacctataccaggcggcggatgacccaggcggagaagcccagggtggactcggtgcgtttcctgccgcccgcgctggccctgaggcagcggcctggggcaggggggatgcgttcgaccttcgggacctccaccgagctgctgaacgtcctgaggctcatgttctcccgcttggcctcccatcgttgccccaacgggcactacgtggagccgaccatgaaggtggccgccgagatcccgatcctctgcccggtgtgcaaagcccgggtcacgcccccgtcggccgaggaactggccttcaactccctgggcgcctgccctacctgccaggggactggcacgattcacgaagtggacgatgccgctttggtgccggacccgaacttgagcattgaccatggtgccgtcgtgccctggcggacgttcggcttcaatgtgcagcccgatattgtccgcgagttcggcgtgcgcaccgacgtgcctttcaaggagttgaaggactgggagaagaggatagtcttcgagggcccggaagagaagaagcacatcacaatcacctcggtcaagggggtgcacgagctggacttcaccttccgcaacgcccgcctgaccgtcaccaaggagctggagcgggccggtgacgacaagcgcatggccaaggtcgccaagttcctgaaagagcgtacctgtcctgactgccagggcagtcgtttggatccgttggcccgcgccccgcgcattcagggacgggggctggccgaggtcaccgcctggtcgctaggagacgtgctggcctgggcgtccgacgtgccgaagagcctgcccgcggacatgcgcactatggccagcgacttggtcgacacgctggaaagcatggggcgtcggctgatgcaactgggtctgggctatttgaccttggaccgtccctccgcgtccctgtccacgggcgagcggcaacgggcccagctttccagggccgtgcgtaatgagaccacgggtgtgctctacgtgctggatgaaccctcaactggtctgcacccagcgaacatcgaaggactgatcggcgtgatgcgcgacctggtcgcggctggtaactcagtggttttcgtggaccatgacgtgcgcgtgctcaaggcggccgactacttcatcgagatgggcccaggggccggccgtctgggcggccgggtcatcgcccaaggctcgccggaaaggatcgcggccaatcctgaatcgcgcatagcaggcttcctgaccggccgtgaaccggtcctggtccgggagcgtcagcctttgccggccgcgaaggcgagggctgacaaggaaagagggaatacggggcaaacggactggattcgtatgcgaaccaagccgattcacaccgttcatgccatggatgtggctattccccgtgggcggatgacggcggtgacaggggtttccggctcaggcaagacgacgatggtcctcgaatcgctcttgccggccctgcaggcgcaggaggagggcgggaggctgcctagacacgtggaaacggtggaagcggctggcatagagcgggttaggctggttgattcctcgccaatagggatcaacgtgcgctccaccgtagccacttacacttccgtcatggacatgctgcgccgagctttcgccgatacgagcgaggccaagcgccgagggctcaagctctccgcattctcatacaacactggctccttgcgctgcccccagtgcgatgggactggccaaatcagcctggacgtgcagttcctgcccgatgtgacgatcacctgccctgtgtgcggcgggtcacgctataagcctcagacccaggagatcaggttgaccaccccggcccacccggaaccgatgagcctgccccagttgctggacatggacgtcacccaagctttgcaagccttcgaccgggcgcccgcaggcctttaccagcgcatccgcaaggccttgggcaccctggacgacctaggcttgggctacctgaagctgggggaggacacgccctcgctatcgggaggcgaggcccaacgcctgaagctctccaatgaactcggcaagcggcagaccacctctttgttcgtcctggacgagcccacgacaggcttgcaccccctggacgtacgcaccctgatcggcgtcctgcagcggctggtggatgggggagccacggtcgtcttcatcgagcatgacctggacatgatcgccaacgccgactatgtgatcgacatgggccctggcggcgggcaggagggcggatcgatcgtggcggccgggacccccagccaactggcccgcgaccccaagagcgtcaccggcgcctacctggctgagcatctgggcgtgtcctgagtccggccaagcgggagagcgggtcgccgccgcccgctcttcgccgcaagcatgtccgcccctttaggtcggctatggatgatagattgaagttccatggtcagacaacatggaaattctcaagagcacgtcaccaagcacattttcgtcaccggcggtgtcgtgtcctcactcggcaaaggactcaccgcttcctcccttggcaggctcctgcgcagccgcggcatccgcgttcttcagcagaagctcgacccttacatcaacgtggacccaggcacgatgaaccccttccagcacggcgaggtttacgtgaccgaggacggcgctgagaccgacctggacatcggccattacgagcgcttccttgatgttttcctgagccaaaaggccaacgtcaccaccgggcagatctaccagtcggtcctgcgcaaggaacgggccggcgagtacctgggccagtgcgtgcaggtgattcctcacatcaccaacgagatcaagagccggatgcgggcccaggcaagcgatgacgtggacgtcatcatcaccgagatcggcggcacggtcggcgacattgagtcccagcccttcatggaggccgcccgcgaggttcgccgcgacattggccctgacaactgcatgttcgtgcacgtctccctggtgccctacatcgccgcggcccatgagctcaagacgaagcccacccagcactcggtcatggccttgcgccagctgggcatcgcccctgacgccctggtcctgcgctccgaccggccgctcaaccagtcgatcaaggacaagatctccctgatgtgcgacgtggacgaggagggcgtggtcaactgcgtggacgctccctccatctacgacgtacccaagatcctgcatgacgaagggctggacgcctacgtggtgcgcgagctgggcctgcccttccacgacgtggactgggccgagtgggatgacctgttggagcgggtccaccaccccagttccgaggtgaacgtggcgatcgtcggtaagtacatcgatctgcccgacgcctacttgtccgtctccgaggccctgaaggccggcggtttcgccaaccgttccaaggtgaacgtcaagtgggtggcggccgacgactgcgagaccctggctggggcccagaaagccctggacggcgtcgacgggatcgtgatccccggcggcttcggcatccgtggcatcgaaggcaagatcggcgccctgcgctacgcccgcgagaacaagcttcccgcactgggcctgtgcctggggctgcaatctatggtgattgagtacgcccgtcatgtgctgggcatggaggacgcgaattcctccgagttcgagtccgactgcgccaacccggtcattgcgacgatggaggagcagaagtcaatcgtcgagggtcacggcgacctgggccacaccatgcgcttgggcgcttacccggccgtgctggacccagactccctggtcgccgggctctacggggccactgaggtcagtgagcgtcaccggcaccgctatgaggtgaatgtggcttacaaggagcgcctgaaccaggcgggtctgcatatctgcggcaccagccccgacggcgagctgaccgagttcgttgaattggacccctccgtccaccccttctacgtgggcacccaggcccatccggagttcaagtcaaggcccactaagccccaccccttgttcgccgggctggtgaaggccagtctcgaccaccaagccgcgcgcaactgagcggtggtagtcgtcgcgcctgatcacgcggggaccccgctaggtgcggggcccccgcgcgtttctctgccgggcgggtccccttcctctttgaatacccatcacggtccgcgggcagtccatcgcgaatgtgcggcaactcaatccccgccgggtcgttctctcggggtgtccgccggagcttggtagtcgagcgctgctcgatgggcccagtcagggacgatggaccgcgcaggcaggagcgtcagagcgccccttgcgccgaggccatgctgtgggaggaagctacgcctgcggtcttcccgccaacgcggtctatgccgcgcgcaaatgaggtctggcggtttgccaccgagaaggatattctggattcaatcagccaggccgctccgatgcggtccgcggggtgtaaggaggtccgtacgcgtgagtgacagctcgaagcaagcggatacggtgcgggatgtggagatgagtcagtatgtcgctgaccgatcccgcgtcaatgaagataaaatcaagcaggatgacgagatcctctcccaattcggggattacaactatggttggcatgactcggatgccgctggcgaggccgcccacaagggcattgacgaggacgtggtccgggccatctctgcggacaagcacgaacccgagtggatgctcgaacgtcgcttgcaagggtacagggctttcatcgacaagcccatgcctaagtggggcgtggacctgagcgatttcgacgcccaggacttcaagtactacgtgaagccgctggataagcaggcccagtcttgggaggacctgcctgcagacatcaagagcacttacgaccgtttgggcatccctgaggccgagaagaataggctggtctccggcgtggccgcccagtacgagtccgaggtcatctataactcgattcgtgaggacctgaaggaacaaggcgtcatcttcatggacaccgacacggccctccaggagcacccggaccttttcaaaaagtacttcggcaccgtgatcccggctgacgacaacaagttcgccgccctgaacaccgcggcatggtcgggcggctctttcgtctacgtccccaagggagtccacgtggacatccccctccaggcttacttccgcatcaacacgccgaacatggggcagttcgagcgtacgctgatcatcgctgacgagggatcgtacgtgcactatgtagagggttgcacagcgcctatttacacgaccgactccctgcatgccgccatcgtggagatcatcgtcgaaccccacgcccgcgtgcgctacacgaccgtgcagaactggtccaacaacgtttacaaccttgtcacccaacgagcctatgtgcgcgaaggcggcagcatggaatgggtggatggcaacatcggttccaaggcgaccatgaagtaccccgcctgcatcctggccgaaccgtacgccaggggcgagaccatgtccctcggcttcgcggggcaaggccagtaccaggacaccggcgccaagatgatccacttggctccgcacacctcatccaccatcgtctccaagtccatctcgcgcaacctgggccgtgccgcataccgtggattggtcaaaatcgccaagggggcggagcactcctcctcctcagtggtctgcgacgccttgctcgtggatgagtactcgcgctccgacacctacccacatgtggatgtacgtgaggacgacgtgaccatgtcccacgaggctacggtctccaagatttccgaagaccagcttttctacctgatgagccgtggcctgagcgaggaggaggcccgtggcatgatcgtgcgtggcttcgtggagcccatatcccgtgagctgcctatggaatacgccttggagttgaacaggctggtggagctgcagatggaagggtcggtcggctgatatggcacagcgtgaagcaacgaacatcccgcaaggcccaagtggggacccctacgcggccccagctaggatgccctccagcgccgataggtccccgcgctccttcaacccgggcgatttcgccatccccacgcgcaagcaggatgactggcggttcactccggttgagcgcctggaggagttcttccaacccttccatgcctcgggccgcaccgcggttgaggtcagcgcgatggacggaggccccctggaccaatctcaggtcacggtcaacacagtcggcatgggtcaggcgccttccgggaccgtcctcaagcccagcgatcgggcgtcggccatcgaatgggcctgcgggtccaaggcgaccgtggtctccctccaggggcgaatcagccagcctgtgctggttaaggtcactggcggcggtcaggacttggacgctttccatctggtcatccaggtcgctgatcaggcccatgccgacgtggtcgtcgagcacgagggcgacgcccgcttggctgagggggtcgagatcatcacgggccgcgattcccaggtctccaccaccttcattcaggagtgggctccgacggccaaggaggtcagcgatcagcgcatccacatgggtcccggcgccagcctgcgccactcggtcgtcaccctaggcggcgacgtggtccgcatccgcatggaccaggagttcggcggcgagggcggcgatctgaacatgctgggcatctacttcgtggaccccggccagcacatcgagcaccggaccatggtggtccacaaccacccacggtgcaagtcccgcgtggtttacaagggcgctttggacggccctaaagcccactccacctgggtgggcaacgccctgattcagccgaccgcttccggcaccgactcctatgagctgaaccggaatctggttctcactcccggtgcggtggctgattcggagcccaacttggagattgagaacggcgacatcgtcggggcagggcacgcctcctcggtcggccgcttcgaggatgagcagctcttctacctccagtcgaggggcgtgcccgagcgggaggcccgcaagctggtggtccgcggcttcttcggggaactggtcgaggagataggcatcccatccgtctccggacatctgatgaacgtcatcgaccggcggctgtccaagggggagaacgaagagatgaagcacgttttggagggtaactgatatgtcgacactggaaatcaaggatttgcacgtctccgtggagaccaaagagggacgcaagcagattctcaagggcgccacgctgaccatcaattcgggcgaaacccacgcgatcatgggaccaaacggctccggcaagtccacactggcatacacgctggctggccaccccaagtacctggttgattccggccaggccctcctggatggcgaggacctgctgaagatgacccctgatgagagggccaaggccgggctcttcctggccatgcagtacccggtcgaggtctcaggcgtctccatgacgaacttcctgcgcaccgccaagaccgaggttgacggcaaggcgccggcgattcgcacgtggaccaaggaactgaacgaggcgatgaagcgtctgcggatggaccccaagttcgcccagcgttcggtcaatgagggcttttccggcggcgagaagaaacgggccgaggtcctgcagttggagcttctgaagcccaagttcgccattttggacgagaccgactcgggtttggacgttgacgctctgcgcatcgtctccgagggggtcaaccgggccaaggggagcacggggctgggcatcatgatggtgacccactacacgcgcatcctcaagtacatcaaaccggacatcgtccacgttttctccgatggccgtttcgtcaagacaggcggtcctgaactggccgatgagctggaggaaaccggctacgaccagtacttgcctgaggggtccgactcggagtcggctctggcctgaggccgcgagctgattgacgatttcgctgacgacgcctcgcatggttgtgattggctggcggcgtggaacggctgggtgagtgaaggagtggccatggaaggtttcgcggagattcgcgggcagttcccagctctggatcaggaggtgcacggtcacccactggtctacctggattcggcggccacggctcagaagccccggcaggtcattgaggccgagtcccgcttctatgagagcgataacgcgggcgttcaccggggcgctcacgagctggccgctcgctcgacgatggacttcgagcgagcccggtcccagatcgcgcgcctggttggggcggatgcccgggaagggcatgaggagatcgtggtgacggccggcgcgacggcgggcctgaacctgctggccaccgccttcggcaacgccagtcagggcagcgggggagaggccgcgaaacggttcgcccttgggccgggcgacgaggtggtggtcagcgaagccgaacatcattcggtccttttgcccttccaggagctctgccggcgcactggcgccagcctcaagtggttcggcctggacgaggaaggcaggattcgctccgacaccgctgacagcgtcattagcgagagggccaaggtcgtcgccatcacccatgtgtccaacgtgaccggggcaatcacggaattggagccgatcatccgtcgggcccacgaggtgggtgcgctcgtgatcctggacgtctgccagtccgtgccccacctgccgattgatgtgcacgccctgggcgttgacttcgctgtctggagcgcccacaaaatgtacgggcccaccggcgtgggcttcctgtacggacgcagggagcttctggaagccttgccgccggccagcttcggcggttccatggtggagttggcctttctcgataaacccgcccaatacatggcgccgccggcccgtttcgaagcgggtacgcagccggtcgcccaggtcgtggccgccggcgtggccgccgagtggatgctccaggtggggctcgagcggatcgctgagcatgagagtgcgattaccgccgagctgctgaagctgggtgacatcgagggggtgcgaatcctagggcccacaagccccgaagcccgcataggcacggtcgctttcgacgttgctggcgtccacccccacgacgtgggccagtacgttgactcacgcggcatagccatccgagtgggccaccactgtgctcagcccgtccaccggcatttcggtttgttcgcttccaaccgggcttccaccggcgtctacaacagcgtggaggacgcggatcggctctatgaggcggtaagcggggtgagggccttcttcggcgtgtgaaagcggtgggaggcgttcacctgaggctcagatgggcggtgcaggaccagggatgcaggtaggttggggagcatggcggacgattacggcatgagcgagcaagagcttgagcagatgtaccaggaggtcatcctggacgcggccaagcacccacatggcaggatcgattcagcggatcgtgatgacccagccgcatacgacggttccggtgatggcgctgtcacgctcaagttggagcacgaatactgcgtgcccgctcagtcccagcagttcaaccccacctgtggcgacacggccacggtgcatgtggaagtctcggacggctctgacggcggtcccaatcgtatcgagcgcgtggtgtgggagggtcagggctgctcaatctcccaggcctccctgtcaatcatggtggacctggtccaggggcggagcgtggatgaggctatgggtctggcgcgtgccttccaccagctcatggagtcgcgtggggccggtttggacgacgaagcagcccaggaagagctgggtgacgcgattgccttccagggcgtctcccgctatcccatgcgcatcaagtgcgccctcctagcttgggagggcttgaaagcgtcggtggcgactgcgttgacacggattgatgaaggtgcgggcgatagcgccggggacaaggagagatcatgacggaagcgacaatggaagacactgggggcgagtccccgcaggccgccgatccggagcaggcccccctgaacgagcgggagccgggcgagggaggcatcgccctgaaggccgcggacgagattggccgggccacggccagggatgtgcgtgaggccttgcaccaggtgattgaccctgagctgggcattgacgtggttgacttaggcctggtctacggcgtggagattgatgagaaaggcagggccatcatcaccatgaccttgaccaccccagcctgtccgctgaccagtgtgatcgaggacgagtgcgcccagatgctggcgggcctggtcgaggagttccgggtcgactggacgtggaccccacgctggagcctgaagatgatcaccccggaggggcgggagcagctggccgccatcgggttcaatatcgacaacctccccatcgcttactgaagcccgccgtttcacgctgagccagtgtggggccgcgtctttcgcgaagttctccgatgaatagcgccccttcccggattccgtgatcctgctaggtcccgccctggtaatacaatggggtttccggtccgccgtgaccggcacggcgaatgagaagaaagcatgttgcatgtcgattttcatgggctggaagcttcacggcgatggtaagacattggctcccggagaggttgtggagccagacgagcgattgacctggccgcgtactgcgggcatcggggcccaacacgtgatagcgatgttcgggtccaccttcctggttccgattttgacgggcttcgatccgtcgaccacattgttctttacagcgctttccacggcgctgtttttgttaataaacgccaatgcgctgcccagctacttgggcagctccttcggcttcatcgcgccggtcatggcggtgaccgccgcccataagggattggccgtggcctccttcggaatcatggtcaccggcgccctgctggcgttgatcggtttgatcgtccacttcgctggagccaagtggatagacatcatcatgccgccgaccgtcaccggtgcgatcgtcgcaatcatcggcttcaatctggcgccctcggcttggaagaacttcaaggccgctcctgtgacggccttggtcacccttctggcggtcatgctgatcgcggtcctcttcagaggcctgcttggccgtttgaacatcctgctaggcgtcatcgtcggctatgtcttcgcggtcagtcaggggcaggtggacttcacggcggtcaaacaggcggcttggttcggcctgcctcagttccatctgccccaggccgatttgagcgtcctggccatgttcttaccggtgtccctggtcctggtggccgagaacatcggccacgtcaagtcggtctccctgatgaccgggcgcgattacgacgagcatatcggcacggccctgatggccgatgggatcggcaccttcttcgctggtctgggcgggggctcgggaaccaccacctacgcggagaacatcggcgtcatggccgccaccaaggtctactcgaccgctgcttactggtgcgccgctttgttcgccttcctgctgagtttgtgccccaaattcggcgccatcatcaatacgatccccgggggggtcctgggtggggtcacgaccctcctgtatggcatgatcggcatgttgggcgtccgtatttgggtcgacaacaaagttgacttcgccaagtcggtcaacatgaccgtcggcgcggtcgtcatggtcatcggcatcgccgatttcacgttcgccatccagggcgtctccttcaacggcatcgccattggctccatcgccaccctggtcatctaccatggtctcaaggccctgggtagactgcgcggcaccgtggcgggcgacgactacattcacgaggaccctgagactgagtcctccgagccctcacaacagcggcggtagcccgggactgggctgaacccatcgggcggattcccaagtggcctgccaaccaagcttgcgccggggacccgcccgttgccattccccttacctgtttcaatgctcatgtccacccatcggtgtcacactgggccaatacggtggcacctacatgggcgtcattggcctgtgcttgctgctggtcatggcctgcggggtcctgttcatatggcgtgaacgccaactggcggctgacatcatgcccttcctgcccatcggcctgctcaagcgcccggcctacagcctgaccctgctgctaggcgccctgggcgggatgctcttctccctcttcgtctacattcccacttacgtgcacgttgtcttcgggatgccggtgcggcgcgctggcatggtgatggtcggtgtaggccttggcagcatcatcggttcctggctgggcgggctcctggtcgacaacaaaggcaaacggttcactctggtggtttccagcctgctgattggcgtcgtgtccatcctgatcacgttcaccttgaccagcctgccgatgttccgcgtgctctccctggcgttgggcattgggctgggggcgatgatgtcctcgcccctgcaagtgatcgccggaaacatggccgacagcgccaaccgtatgcgggccatggggggactgtcggccaccaagaagatcggcaccgcgatcgcgccgctgattttcgccaccgccatagaggtgggcaaaagcggagggcaggccggattgccctcgttcaggaatatgtttatggtcgcggctgtgatcgccttattggccgtgctgatcaccctcttcataccattgaaagcgaaggatgagtgacgatatgaataagcaagcgatgacggcggtgctgctgatggcctatggcacgccgagcgagcaggcggacattgagccctattacaggaacatccgtcacaatcacgccaatccaaatccccccaaggccctgctggacgagctgacgcgccgttacttggccatcggcctgccttcgccgctagctaggatcacccaggcccaaggtgacggtttgcaagccttgctggacgaggaggcgcctggaaaataccgggtttacgtggggctcaggtacatcgagccgttcatcgcgcagaccgtggagcgcatagtggcggatggcgccgagaggattatcggcctgccattggcgccggagtactcgtccttttccagcgaaggctaccacaacatcgtcagggcggccctgaaagaacacccggacatcgactacgcgccggtcaagagttggtggcggcagggggagctcatcgacttctggagccagcagctggaggatttgaaggcgttgactgaccggccggacaccaggttgcttttcagcgctcacagtctgctcaggcggatcatcgagcgaggggacccctacgggcgggaggtcaccgatttcgccaaggccatcgcggctcaggctggtctccgccaggaccaatggacccttgcctggcagagcgccggtaggaccaaggagccctggatggggccggctttcgagagcgtggcgcgggaactggtcgccgaggatggggtcaagacggtgatttcggcttccataggtttcgtggccgagaacctggagattcgctacgacatcgacattacgctgaaaaaaatcatccaagatgagggcgggcggctgatcaggctctccatgcctaatgacgacatcaagctgctcaagacccttcggtccaccgtcctggacctggaggagccgcagggctgaagccggacgcggacatcggcgcacacctgggacgcgttcatcgcggggttagcgactggggcgggtggcgtaaaaggcgacggcggaggatgcggccacgtttaaggagtcgacgccgtggctcatggggatgcggacggtcaggtcagcagcggcgatggtgcggtcggacaggccgtcgccttcggtgccgaagatcagggccagcttgtccacctggccctgatccaggcgggcgaccagctcatccaggctgagtgaatcctcccgcagggccatggcggcgctggtgaagccgagctcacgtagctgttcgattccgcgctcaggccagccgtccgggtcgtctccgcctatgcgggtccacggcacctggaagacggtgcccatcgagaccctggccgcccgccggtagagggggtcgccgcaggagggcgtgaccagcacggcgtccacatccagggccgcggccgaacgcatgagcgcgcccacgttcgtgtggtccacgatgttctccatgatggctacacggcgggcgccccggcagacctcgtcgagggagggcaggggccagcggcgcatggcggccaaggccccgcggtgcaggcggtatcccgtgatcgacttcaattgggcgggcgatgccacgtagaccgggacttgggtgccccaccgggcgtcggcccgctcgaacaggggtttcataccctccagccatggttcttccaccaggaatgagatgggctccacttgggcgtccagggcgcgcgcgatgaccttgggggactcggcgatgaacaggcccttgctgggctccagccggttgcgtagctggagctcggtcaggtgggtgtacgcccccagtcgttcatccccgatcgactccaccggcacgattcgcatagccgcccatctccgtccgtttccagcccttttcttacggctttcatcataaccgagggcactgccggcctctgtcgcgcagggattgccgggtaaggaggcggagcctagacaacttcaaaatatattgaaataggagtatgctattgtttaaacttcttagaaggagcatgtatggggatccaggagacgatgtccgccttgtccgatccgatggaccggcgcatccttcggctcttgcagcagggaggggcccaggccggcgcgatcggcgagcaggtggggcttaaactgtccaagctctcctaccacctgaaaaagctcaagggagcaggcttgatcagcgggaggaaagacggcactcgcatcgtatacgagctcaatttgaccgccttggacgagaccatcctctggctctaccagctgcgcaccggcaccaaactgcccgcgctggccgctcaggcaaaggccacgagccaagggtgaggaccagctccggcgcaacccaccgtcgcatcgcccggccctgttcagttcaatcggggaacgggccaatcggaatcgagcatctaccatgagcaacaatcacgagcccctggcgccaccatcgaaagtcagcgagaccgacagcgacggtcctggccggtcccccagcaagggccctggatcgcgtaagaccttgctggcgaggcaaggttttctcggcctggccctgttagtgcttgggctgactcctggtttggctaccgtggcattcgtgccccggcttcccgaacaagtgccgttgcactggggggcggatgggcagatcgaccgttgggggagtaagtgggagatcgtgggcatggccgtcttctgcctggtcttcagcgtggtctggctgatcgcggtccggtacgtgggtcgggcggccgaaaggagtggcgacgaaccccgaagcaatgttcgactctttctaagactcgggctcatctcccaactgatgttcaacgccatcactctcggtgtgatttacgtcgactggtcggcgacggccgctgagccgcccgccctctccctggatttcccccgcatggcatgcggttgtctgggggtatgcatgatcctggtgggcgacatcatgccgcaggtcaaacccaaccggttcatcggcgcgcgcatgccgggcgcttacgccagccgcgacgcctggaggcgggtgcagcgggcctgtggttggtgtttcatcgccttaggggctgccaccctgctggctgctgttgcgcagggtgcggccctgggatgggtggtgctcctatccggcatggtcgccacatccgtgttcatgttggcctacagcgcccaagccggcaagaagcatggctcggacgggacctccaccaggcgctgaccggccggtgcaggccaacccctcgcccctggaacggctcgcggcacacccttgatcccgggacaaggttagggcaagccttccgagccgggcgcgccctttcctgccctggtggaaaacgacggtaggaggctgatgggggaatcatcatgagcagggaggggcggttcccgaacgcggcttgttcagcggcggtggcgagactcgcgccacgctacacgatgtccttacgggcgagcgaaggctctggggaaactgtgtgatattcgggggaataggctcatcggcctggtgtccggagcgggagtcgaacccgcatgcctgtataaaataggcactagcacctcaagctagcgcgtctaccattccgccacccggacgagtgcgaagacaacatgaaaactatagcactccaccccctcgctcgcacggacgccatcgagggcgtgtcgccgggcatggcttacgcgccgccggccaggcgctcgcagggtcgccggattggcttcgccgcgctggttgagctggcccgtcttccggccttgccgctaggatggcctaccatgaccgacccccttttcctcttcgaccccctttgcgacgatacgccagtcaaagccgacgagttgcataccgggtggaggctgaccctgccaccgagcgtgcgtcgccatgccttctccgccatgcgcctcggcctgggggaccggctccagctctccgacggcgctggtctgcgcatcagcgcactggtggaggacccttccactggcctggtcgaggtgaccggcgtgggcaaggagccaaggcccaggacctgcctgactttggttcaggccctggcaaagggaggccgtgacgagcaggctgtggacatggcttgccaaatcggtgtggaccgggtgctgccttggcaggcggaccgttcgattgtcaagtggaagagcggcaagatggagcgtaagtggggcgccctcttagacgccgcaagcgagcagtcccgcaggtcctggagaccggtcctggagccctgcctcaccaccaagtccctggtcgcgtactgccgtcgtgagtgcgagtcaggcgccctggtcatcctcctccaccaggacgcgacccgctcctgggcgcagacgcgccggggcctggaacgcttggccaaggacaacgacgagccaagggtggcagtcatcgtcggacctgagggaggtgtgagcgagcaggaggcggacgagctgacccgagtcggcgcgatcgccacgaccttgggccacaatattctgcgcgcttccacggctggtgttgtggccctgaccgctgtctgcgatgccctggggcgcttcaacggctgagcccaccgctgcagggatttgatccctacgcgcgagcggggcgtttatccggcttacgccataagatggtaggcatggcacagggcccggctggggctcaggcgagggttaggagcgcgaatggttgagagccatgcggaggatgactgccttttctgcggcatcatcgccgggcgggtgcccagcgagaaggtctatgaggacgagagtctgtacgcgttcaaggacgtcaatcccaaggctgctgttcatgttctgattgtgcccaaacgccattatgccaacgtggccgagctggccgcggcggaccccgagcttctggccagcatggtgatcaaggctcaagacatcgccgatcaggccttccacggggcctaccgattgattttcaacaccgggaaggacgcgggccagtcggtcttccacgtccacgcccacgtactgaccggagaggtcatggatgagtaaagcgatgggtgggacggggcattcagggtggctgtgaccaaacgcgcaatcacgattccctccggggtggacccggtggcggtgctcggaccgggcgactcagtcttgcgggaggtcgagcgggccttcccaaccgtcaacattcttgctaggggcaatcgcatcctcctgcaagcggactcagccgaagctgagggccaggctctacgggctcagcggctgttggagaccgtgattgattctgcgtactcggcccccctcgacgcgggagccgtgcaggagctcttggaccgggaccgctacggcgaagccgcgcccgcgcccactgccggatcgtccgcccccgtggtcaaggaaggacgcagagctgattcctggctccacgaggccgattgggaggggctgtttgaaggggaggggcggcgtgctcgcgtccctggcgtcatcgcctacgcggcagggcggccggtgcgacccaagacacgaggacagaccggctatgtgaacgcgatcgccagtcatacgatcaccttcggcatcggccccgcaggtaccggcaagacatacctggcggtggccaaggcggtccaggccttccgctcgcggcaggtcagccggatcatcctgactcggccagcagtggaggcgggggagaacttaggtttcttgcctggcgggctcaccgagaaggtcgacccctatctgaggcctttgtatgacgccttgtccgatatgctgggtggcgagcggatgcgccatttcatggagaacggggcgattgaggtcgcccccctggcttacatgcgtggtcggacgctcaatgatgcgttcgtgattctggacgaggcccagaacacgacccgccagcagatgaagatgttcctgacccggctgggcttcaactcgaagatggtcatcaccggtgacgtgacccaggtggacttgggcctccccgcttctggcctggtgtcaatcgaggagattctggggggcgtcgaaggcatcgccttcgtgcacctggccgccggcgacgtggtccgccaccagctggtcggccgtattgtcgaggcttatgagcgttacgccagcgctcgcccgcagcggaagcaaacgactagcgatccgggggagggacggtcatgagcgtggaagtgaccaacgagacccagtggctgattgagccgaagatcttctctgacctagggttgtgggtcttggaccagatgcgcgtgtccacccaatcggacatgacgataatcttcaacgacccggaacctatggccgtcctccatgagcgttggatgggactggaagggccgaccgacgtgatgagcttcccgatggacgagctgcgccccggcgagggcggctccctgcccgaaggcatcttgggcgacatcgtgatctgcccctgggtggccagtaagcaggccgtagctgccggccattcgaccatggaggagatgctcctgttggccgcccacggttgccttcacctcttgggctacgaccatacgacccgggtccaggagcatcagatgttcggcctgcaacgccagctcctgctcacattccttgcccagcggccagggccgatcgagcgggccgcgctgccagccggcgcgcctgacgccctggaggtttacgaacgcgcccatccgggcgcttcgggtgggcacgaccaaggcaggcgggcctcatgagcgctcaaatggtcctatcggcgattggtctggtcttggccgcccttctgctggtctggctgtccctggtcatggccgctgctgagggcgcggtctcaagggtcactaagtccagtctgaacaacctgattctgggactgcagaccgacggtgagctcagtcaattctcacgcatgaagcgcatcgataaggttcaccgggtccagtccctgatcgtcgaccgccacgccaccaccggatcctgcgccttcttccgcgtctcctgcaatatcctgaccggcatcctggcctcctgcttggcggctttgttcgccctgcccctgtgggccaacctcctatgcggttttgttttcgccattctcgtagccatggtttcggtcatgacccgccctcgggtcagcggggcccgcaagcctgtggacatcatgctgcggcatgtgcgggccatcggcctggctgtgcgcttaacccccttcgcccgttccgccagggaggaacgtggaggcaagacgggccgtttcagcgacctttcggatgacgaggaactggagaaaatccagattgagcagggacgggctatggtcgatcagctggtcgaagccggcgctttcgacccggagatctcggaaatgctggataacgtcctgacgctgtcaagcacgctgacgcgcgagatcatggtgccccgcaccgacatgatctgcatcggtcaggacacgtcactgtcttcggcgctcaagctcttctcccgttccggcttctccagggttccggtgattggtgaggacgtggacgatttgaaaggcgtcctctatctcaaagacgtggtcaaaatcatcgccttcgagcgcgaagccggctcccgtactgcagggtccttggcacgtgaagcgaacctggttcccgagtccaagccagtggacgacctcttccactccatgcagcgcagtcgccaccacctggctgtggttgtcgatgaatatggcggcgtcgcaggcctggtcacgatcgaggatgcgattgagcagatcgtcggcgagcttgaggacgagcacgaccggattcaacgcgaggaaccccagaaaatcgggcccaacgtctggaagctgcccgcccgcaccccaatcgccgtcctggaggagatcttcgagatagacatagacgaggacgatgtggacacggtctacgggctgttgaccaaactccttggatcagtgcccatcgtcggctcttcggccgtgacgcgaggtctgaaactaaccgcggcggacgcggctggtcggcgcaagaagatcgccaccatcatcgtggagccagccgcgcgttcggcagaacagggcgggcaggccgagcgtgaagacgcggccgcaagccaggagtagtctgaaatctcacagtgcgcggccagaccgggcagcgggttcaaacgttcaatcggaagcagggagttacggatatgagtcaagcaggcgacgccaaccagggcggccacacgcgggaggcggaccggcccaaagcgggggcggaaccctaccggtcgggcttcgcggccgtcgtgggtcggcccaacgttggcaaatccactttgatcaacgctttggtggggcggcaagtcgcgatcgcctcctcgcgtccggagaccacgcgcaaggccatccgggggattgtgaccaccgaaggggcccaaatcgtgcttgtggacaccccaggcatacacaagccgaagaccctgttgggcaagcggctcaatgaggtggtccaggactccctctcgcaggtggacgcgattgccttcctgctgccggccgaccaggagattgggccgggtgaccggcggatcctgagtcgtctgcgccaggatttcgcaaaccagaagcccgatggaggatggaagtggcgtcggccgctgatcgcagtggtcaccaagatcgacgagctggaccgcaaggcccttatggccaagctgattgagatcagcaccttcgccgatttctccgacgtggtccctgtatcggccctggccaatgacaacctggatgaagtcaagcgggtcctgatcgccgccatgccagccggacctcagatgtatccggctgaacaggtgagtgaggagaagccggaggacacgatagccgagctgattcgcggggccttcctggaggagctcgacgacgagctgccccactccctggccgtcgtcgtcgacgagatcgagatgcctggccagcccttggacccagccggacacacctcggacaaagccctggtgcgtgtctcgattttcgtggagcgcgactcccaaaagcccatcatcatcggacgtggcgccgaaaacctggttcgtgtcaaaaagcgcctgcgcacgcaggtcaaccgaatcctaggagtgaaggccaagctggatctgcacgtgcgggtggcgaagaactggcaaggcgaccccaagcaacttcaacgcctcggcttctgaacgatagcgccccgtttcgcctgggtgggcaaggcgaaacggggcgctatcgtaagtggatggaccctactttttagtattttttggcttcttaggcgtgtacatgcgcgtcctgagcaggtcggcgtaacgttccaggaccttgggccggatgaccttcatggacggtgtcatcagcccgttctcctgggagaactcctcgggcaggatgatgaacttgcgcaccgactccgcccgcgagaccccctcattcgccttgtccacgtattcttccacttcggcgcggaccgccgcgttggaagcggcctcctccatcgacatgtcggaacccaggccctcggagcttagccaggagcgcagggcctcctcatccagtgtgaccagggcggagatgaagggccgtttgtcgcccaagatcagggcctgggagacgattggggagcgttcgatgatctcctcaatgggcctgggggagacgttcttgccgcccgccgtgatgatcagatccttcttcctgccggtgatgtaaaggaagccatcgttgctcagacgtcccaggtcgccggtgccgtaccagccgtccgctgtgaagaccccagccgtggcctgtgggttcttgtggtagcggtggaagacgcaggtccccttgacttggatctcgccgtcctgggcgatgcgaatcgagaaacctgggaaggggatgcccactgaaccctgccggtaaggggtgcccagggggctgaaggcgcagggggcggtggtctcggtaaggccgtaaccctcgtagacgggaatcttcgcgccacggaagaagctgaggagggagtggtccagcggcgctccgccggagacgatccacttggcccgccctcccagcacctcacgcaaggatgagtagaccagcgggtcgaaggcggcccttcgtagggcgtccttgcgggtgggcttgccccgcttggccacatcggacatgtagtctcgggcggcgcaggcggcttgggcgaagacgacgcccttgggcccgtgcccggctttctgcgtggcagcgttgtagatcttctcgaagaccctgggcacgccgatgacaacggttggcttggactcctgcaagtcggagagcaggttattgagcccctgggagatgtagacctgcatggaggccgagatgaccccgtatgatatggcccgtgcgaaggtgtgggcctgggggaggaagaggaggatggacccgtctgggtcatcggtcaggttggggatgaatgaggtgaggttgcgggccagggtgcagtagtgctcgtgggtcatttcaacgcccttgggggccgctgtggatccggaggtgtagacgatcgagcacaggtcggtcttcttgaccgagcggatgcgctcgtccagctcttcgtccgatacggagttgccgtaggcctggagctcttggagggcgccagtctccaggcaggcgatgcgttccagggaagggcactcctcgatggccccatcggccttctcccgcatggccttggtctggacgatcagcagccgggcgtcggagttgtcgacgatcagacgaatctgctcggccgaatcggtgtcgtaaatcgtagcgatgacgccgccgatggacaggaccgccgcgtcgacgatgtcccattcataggaggtttggcacatgaaggcgaccgtatcgcccttcttcagccccgaatgaatcaagcctttggcggccgtgcggatgtcgttcaaaacctcggaaccagtgcggtacacccactcgccgtcttgacggaagtggagcatgggggagtccggagcccgcttggcgcggccctcgtacagggtgtagacggtcatgtcgtcgggcacttcgccggcgcccgccgtacacgcggtgagcagccctgatttcgcgtccatgtacgtagtggtggggtaaccgttggaccagtcatgcgtgttgggcaggcccacatcgctgccgggcgcatggacgaggctctgattgccgggattgtcggctaaggccttctgcggttcggggccaccattgcctgaagccttctcggaccgcttgtgcgcgtaggacttaatcgtctcgaacaatgccacctgtgctcctaaccgctaatctatacactcaagcctatcctgccacttggaaattgggcgtctggaggaaaccccggcctatgcggctccggacaaatataaaaaagcccggaatccgaaagcggattccgggctgcccgtggagctagggggaatcgaacccccgaccttctccatgccatggagacgcgctaccagctgcgccatagccccgtgtcgcgaacctttgacagcatacacccacgttgcttgagcgtgcaagtcagtgtgtcgcggcgccatcgctagggttcaacgttgccggcagcgaccgatggggctgggccggcgccccttgcgcggcctgcgtccagccgctttgacgcctatgatggtggcatggatgcaacacagcattttgactccggtccgtccgcatcggccccaggccgtcaaggccaggccccggaccccgcgcaggtgcgaatcgtcaactgcttgcccctgaccgaccaagagcgagcccgattccagcaagccgggcgtggagcccagcagcgcttcatcgcagatgcttccaacagggaccagccaagttggaagatggacctgcccgctgatttggtccaatgggcgaccgttgtgatcggcaacccaccagccgcgcaggtggcctcttgtgggagtttggaatggctgcagaccgccacggccggcgtcgacgcctaccagaaggagggggtcctgccttcgggagccatgctttcgggggcttcaggcgccttcggccagtccgtctccgagcacatgttcgcgctgatgtggtccctgatgaaggggctcggcctctacagggaccagcagcggctggagcgctggggctacttgggtcaagccttgtcgccgcgcggggcgaccgtcctggtggttggcaccggtgatttgggttcacatttcgcttgtctggcccaggcggtcggggccaagaccctcggtgtacggaggagccccgagcacccggccgaaggcatcgacgccatgcacggtttcgacgaactggacgacctgctgccccgggccgatgtcgtggccctggcggtgcctgcctcgcccgacacccaccacttgattgatgcccgtcgcctggacttgatgagcccgcaagccatactgatcaacggagggagaggcgatgcggtggattgcgccgccctgtcccaggccttggaggaggggtcgatcaggggcgccggcttggacgtcaccgaacctgagcccctgccagccgggcacccgttgtggcggcaggagcgttgcgtgatcaccccgcacgtgtccggcggcactaacctgtcggccaatggggagcgcatcgttgccattgctttggacaacttgacccgttacatgcaggggcgggccttacgcaaccgcgagcgctgatggagccccacaatgggcggctccaggttggcggcggcccaagccctgatcccggccgtcggcgcgccaaacggcgccggccctcgacaatggctgccaccagggcgaccgtgatccgaaaacgctggtgacggccgacgccatgtctgaatcccataggcgccacccgggcttgcgcttcccctaggggtttggagaccaccctggttgtttcgtggctgcccgaaggcgtcgcatcgtgttgaggtcaacagccgggctatcctaggagggctggcccggtaggcgagtctctagcgccccgccacggggcagggcccagtaccataggcaatcgggaaggtcatgggttacgcagcggaaggcggtgacagcgatgatgagggtattcagcacgatggccgggcagatcgagcagataggtgccgcccgcaaaggctcttggatttgcctgtctgagcccaccgatgtggagctggctggcgtggcccaagacaccggcatcagtctggccgacctgcgcgcaccgcttgatgacgaggagcgaagccgcgtggacgtggaggatgactacacgatgatcatcgttgacatccccacgatggaggagcgcgagggtcgtgatttctacgagacgatccccctgtcgatcatcgtgaccgaggacctgatcatcacggtgtgcatgcaagacaccgtcctgcttcatcccttcatggaaggcacgatccgcggtttcaataccttcatgaaatcccgcttcatcctgcaaatcctctaccgcaacgccggcatgtacctgcgctacctgcgcatcatcgaccgcgagtccgataagctcgagctcaagctgcgctactccatgcagaaccgggagattctgatgctcctggagctcagcaaggccctggtctatttcgccacaagcctgaagtccaatgagatcgtgctggagaagctgaccagcctggaccgcatcaagcaatacccggacgatgaggacctcctgggcgatgtgatcactgagaacaaacaggccatcgaaatggccaatatatactcttccgtgctttccggcatgaccgatgccttcggctcgattgtgtcgaacaacttgaacaacgtcatgcgcatcttcacgatcatctcgatctcactgtcggtgcccaccttgatcttctccatgtacggcatgaacttccagaacggcatgtcaggcatgccattgaccgataagccttgggggttcgtcgcagtggtcctgctatcagcggcgctcacggccctggtcacctggttcctgacccgctcgcggatgttcaaatgaggacggggatatggccggcaaagggttgaggggactgagacggctggccgtggccctcggggctttcgccctgaccgtggggctcggtgggtgcggggggcgggcctccgcttacgacgtcagctccatcgggccgaagattcacgtgggggtgctcgccgaccagcctggactgggcttcgtgcgctccggcaaccgctcgggtctggacttggatgtagcgcgctacctggtgcatgagctggggttcgttccctcgcagatcgtgtggcatgacgtgttgcccagcgaccgcgaggaggttttggaggcaggccaggtggacatggtcgtggccgcctattcgatcacctccgcccgccaggagcaggtggacttcgccggtccctattttgtggcggcccaggacctgctggtgcgcaaggccgactcgcacctgggcggcgtccaagacctgcgcgaccgcaaggtgtgcgttttgtccggctccacctcggagcaggcgatcagcaaccaggccccccaggctcgaatccaggaacgcgagaggatcggggcatgcgtcaccgccttgctgagcgggcaggcggatgcggtatcaggtgacgatatcgccctggccggcgcgtcctcggtcatgggcggcgggcagctgaccttggctggagcccgtctcggggccgaaaactatggcgtggccgtccggcgagggcaacctgaactggtcgcggcaatcgacaaagcgctcaacaagatgcactcggacggctcatgggggagggcggtgcgatcggccgcctccgcgatcgactaccatgtcgatttgaccgccagcgatccatggcgagccggctccgcagctccccgctccaaccgttgaacgaagacgcatccaggcgcacgcgtccacagagcggacgaccgctggcccgtgtccacgcgaatgtggataatcagtgcctatgagcgcgaatgagaacagtgaaaaacaggcagacgatggggcgactagcgagcccgcctaccgatacaacgcccaaatggcccagaccatcgaaggcaagtggcaggaacgctgggacaaggacggcgagttctgggcggccaacgtctccggaggcctgaccgatggccggggccggaacgctgatggagccaccccctatttcgtgattgacatgttcccctacccttcgggcaaggggctgcacgtgggccaccccttgggatacatagccaccgacgtggtctcccgctaccatcgaatgaagggggagaacgtcctgcacgccatgggctacgacgccttcggcctgccggctgagcaatacgcggtccaaaccggccagcaccctcgggtcactaccgagcagaacatcgccaacatgcgttggcagctgcacaggctggggctcagcttcgacgaccgacgcagtttcgccacgatcgacaacggctacatccgctggacccagtggatattctcgcgtatttatgaatcctggtacgaccctgacttccaacggcgggacggcggcctggggtcggcccgaccgatcagcgaactggaggaggccttccgctccggtgccaagccgattcccggtcatgagggcgggggagcggtttgggaccagctggccgaggccgagcgctccgagatcctcaacgggtaccgcctggcgtacatctccaaatcgccggtcaactggtgcccgggcttgggcacggtcctggctaacgaggaggtcacggccgaagggcgctccgagcgcggcaacttcccggtattccagcgcgagctcaaacagtggtcgatgcgcatcacggcatacggccaccggttgatcgaggacttgggactcctggattggcctgagaaggtcaagctcatgcagcgcaactggattggcgagtcgcacggggccctgatccgcttccaggtggaaggaggcgacagcccccagagcatggaggtctacacgacgcgccctgacaccctgttcggggccacattcgcggtcgtctcgcctgagcacgccctcctggagcatgtgccccaggactggggagccggcattcccgactcttggaagggcggatacgagaccccgaccgccgctgtggccgcataccgcaaggccgcgcaggccaagaccgccaaggatcgcgtggatgaggccggggccaaatcaggtttgttcaccggcctgtacgtggtgaatccaatcaccggcgcgcgcctccctgtcttcaccgccgactacgtgctgatggattacggcaccggagcgattatggccgtgcccggtggcgaccagcgcgactatgatttcgccgccaagtatggactgccggtcatctatacggtccagcccctgcccgagtcgggggagagcctggacgattaccgaggcaaggccccgttcgtctcccacgatggtgtcgtcgtcaactccagtgtggagtccacctacgccaagggcgacgccctgagcctggacggcctgcgtgtcgatgccgcgatcgaaaaggccaccgcctggctggaagcggccggcgtgggtcgcggggaaacctcctaccggctgcgcgactggctcttctcccgtcagcgttactggggcgagcccttcccggtggtctacgacgaggacgggctgccccacttgattcccgacgaccagctgccggtcaagctgccggaggtgcccgactacagcccgaagaccttcgaccctgacgatgcggaatccagcccggaggcccccctgagccgcaacgaaggctgggtcaaggtgaccatggacttgggccaggggccgaagacctactaccgcgacaccaacacgatgcccaattgggccggttcctgctggtactacatgcgctacatcgaccccggtgacgagcgccacctggtcgagccggaggagttcgactactggctggggcccaaccacaacgccagcgccggcgcttccggcggcgtggacctgtatgttggcggcgtggagcacgcggtcctccatctgctctacgcgcggttctggcacaaagtgctctacgacctgggctacgtgagctcgcctgagcccttccataagctcttcaaccagggcatgatccaggcgtacgcctacaccgacgaccgtggccagtacctgcccgccgccgaagtggaggggcacgaggaggatggccggaccgtatacagctggcagggccagcacgccaaccgcgagttcggcaaaatgggcaagagcctgaagaacatcatcaccccggacgacatgtacgccacctacggggccgacaccttccgcctctacgagatgagcatggggccgctggccgagtcccgcccctggaacacgcgcaacgtgatcggcggcatgcgattcctccaacgcctgtggcgcaacgtgatcgacgaacccaccgggcagttgagcgtcagcgaggcggaaccggatgaagagacgctcaagctcctgcaccgcacgattcgtgacgtgaccgaggagatggagggcatgcgccccaacacggcgatttccaaactgattgtgctcaacaaccatctgaccggtctgagcgacaaaccccgggcggtcatcgagcccctggtcctgatgctctcgccaatcgcccctcacatctgcgaggagctctggagccggttgggtcacagcgagtccctggcccacgccccttggcccagctatgagcagcgctacttggcccaagagcaggtcactgcggtggttcaggtcaagggcaaggtgcgcggcaagctccaggtgagcccctccatcagcgccgacgagcttcaggcgcaggccctggccctgcccgccatccaggaccgcttggctggcaaggagccccgcaaggtcatcgtcaaggccccccggatcgtttcgattgtgcctgccgactgatcgctgcgcacattcgaccacataggccctcccgtctggatttcgacgggagggccttggcatgatgggcccatgcgcaaccatcaaggcagtcaggatcaccgtcttcagcggacgggactacaggcgcgagcgccgaagcgcaggcgtcttccgccgccgcccccgtccctggcatcgtcgcctgggatggacgcggactcatcggaaccgcgtatgcacaggcctgcagccttaaccgcctccgatggctggattccactggcgaagggcagcctggccgccttgagcggggtgcgtccgggggatggcgacgcccggtcatgggctgttgattcggaagctgctcgggaccggccccgtctgctggtcaagccggtccatgccatgattgtgattctggtcctgactgtagccttgtgcgccagcttgaccctcttcatccagcaggcccgcaacttggagcagacgggctcgtttgctgcgtcccatgccaattcgcctcctgccaccggttcatcaaagtctttccatccccccacgtcggccaccaagccccagccttcaccccagcgaggcacccaagctcctgatgcaacggtccagtcccaggccgggcccctgccgccgggggttgtggacctcaatacggcggacgtcaaccaactcgacagtgtcaacggaataggaccggtcatggccaagaggatcatcgactaccggacgagcataggccggttcagctcggtcgaccagcttctccaagtcagcggaataggccccaagaccctggagaaaatcagggacaggctggtcgtgcgatgaatcaggatgacaggcagcccaacagtgaggccctgatggatgcaaggcgggaacgggggagccaagactggcggatgctgccctgtctgctggcggcctggtcggccagcctagccgcgcagctcctcttcgaccgttggctgagtccttccgccgccgcgcgttcgcagagcgcggccaagtcccaggagggcgcgtcacagccggttggccggtacttcttggccctgggggtgaccggaatcgtctgcgtcgtagccgtagccttggtttgggtgggttggcgcgggctccaaccgtcgcgcccgattcgcatccgccgcacccgtggcactctcgtcgaccgcttaggcagtctggtcacgctggtcctcctgatggtcgttactgcggctgtggagggcggagccggcctttcctcggccatggtggcggaaggggacggggcggtccgcgaggcgttgtccggcccaaccatcatcaccgcgagggtcaggtcgcgctcgccgactatggcttcggaacgactgggccaggagtgcagggccgatgtgaccattgaggggttggatgcttccggtttggtcctcggctcgagagcgcctgcccggctctacgccaatggggctggttgcgccctccgtcagggtggggtctaccaggtgcacggtgagctgcgattggcgggtttcggcaggtcacgtctctggctgacccttcccaaggaagaggcgaaccggtccaaaggttcccgctcgccaccccaggctggcggcgccttgcgccagttggaggcgccggaccgcctgtccgcgggcatgtccgccatgcaggacgccttcctcgcgctgaccaggggtcttgacgaccaaggcagggttctggtgccagggctgaccttgggggtgttgggccaggagtcctacctgttcggtggtgggtccggcgatcacaccgttccggcgtacgccagccggctgagcatgaacttcaaacgctcgggcatcatgcacctgatggccgtctcaggcagtcactttctcctcatagcctcactggtccgatggttcctgcgccggatgcgtgcgccgcgctggttccaagcggtggctctggctgccgcttgcttgtcgctggcccgggcgatgtacccctccgactccgtgctccgggcgcaggccatgagcctgctgtcggccctggccatggggttggggcgcaaggggcagtcggtggccgctctgtgctggaccgccatgctgaccctgttggtccatccgtcaatggcccgctcgtttgggtacgcgctttcctgcgccgctgtcctgggcatagcgactgtcagcggccccctggccgacgcttgtcgggaccatctgccctcttttctggcgcaacccttgtccgtgaccctgagcgcccaggccgccacgctgccgatacaagtccttatgtcgccgcagctgccggtcctatccgtcctggccaacctgattgtgacgccattcgttgacgtggcgaccctgtgcgggctgctgggtctgtgcttggccatgccgtgcccgccgctggccgtggtgctggttcgcctgtcctcctggggcacctgggtcatggagcgaaccgccaccggcataggcgaggctggccttgccgtcctgccctggccgggtggtttgattggctccctagccatcgcgctgaccgaaggagccctggtgcttctggcattatcggccgtcctgctccggcgccggctggggctgagccgcgatcctgtaatggggtcgaaccgtttggagccgggcccagctctgggcggcgcatcctaccgtccgaccgcctggctgcgtctgcgctcctggttccacgacagctggcagcgcttaacggccttgtccttcaccaaggtgaccagggccggacctgggtctcccgcttgtccaccgataaagagaaattagcagtatgacacaagatcagtcggctgtctggccgttcacaatcctgaccggcggggacgctttcctggctgaccgagccatgcgctcgctgcgtgatcaggcgaaagccgtccggtctcaggctgaggtggtcgagttggacgccggccaatgcgatgcctacgccttcgatgaggcgatcagcccctcactcctatccgaggctggagtcgtgctggtcaacaacctggatgatgcccgggatgcattaggcgaggcgatggtcgccttttgcgctcaagccgtcaaggatcccgaatccgacagcgtcgtgatttgccgccattcgggaggtaataaaggcagaaggctgctggcggcgttggataaggccggggcacgcaaggagcaggtgcccaacctgaaacgggccgacgacaaactaggtttcgtcctcgatgaattcaagcggcggggtaggcgtctggagccccaagccgcccaattgctggtcagcgtcttaggcgatcgcaccgcggagttggccgctatgtgcgagcagctctgcttcgatttcgaccaggacccactgaccttggccgtggtccaggagtatttgaccgacgacccccaggcgggctccttcctgattgccgaactggccatgggcggcaatggcgcgcaagccatcgtcgccatgcgcgaagccttgcggcagggagtggatgctctggccatgattggagccttggctttcaaagtgcgcttactggccaaggtcgccgccctggacgctggcaagatcgaccagagccaagtgggcgcgccgccctggcaggtgcgccaggttcgacggcagttgaagagttggacttcgtccagcttggcccgggcgattgaagcgttggcccaggcggatgaacgacgcaaaggggtgggcggcgaccctggctatgcggtggagcgggcccttagggtagtggcctccaaggggaaggaagcatgagcgagattaacgcggatgacggtcgtgccctgcttctgaaggcccctacggctgagcggatgcgcgcgataggcgcggccctggcccatatcgtgcgcggcggtgatgtgctggtgctctcaggccctctcggagccggtaaaaccacattggcgcaaggctttggacgggggcttaaggctgatggcccaatcgtctcaccgaccttcaccatcgctcgtgagctccagggccaggccgctgatggcagtcctctgcgcttggtgcacgtggatgcctaccggctgggctcggccggatacgagccgggacaagacagcacaaacctgctcctggaccaattggagtccttgggtctggacgaggagctggaggacccaggcgagcggaccgtggtgctgatggagtggggccagcagatggcttccgccctggcccccgcccggctcgaagtgaatatcgagcggcctttgaaagccgacgacgtgggtgacgaggcccttaccagcaagggcctgcggatggttcgcatccggccggtcggtgattcctggaaggagaggatgggatgcgtgcggagggtgatggaagcatgagcggcagtgatggtaaggcacagggcgcggggcaggaaggtcccacgctgattatcgacacctcctacgggatgaccatagggctggaaggcggggagccggttgtggaggaggagtcccgccggcacgtcgagcttctggagccgaccttggaccgtgtcatgcgccaggccggtttgaaggcgaacgatttgcgcgcgatcatcgttggagtaggccctgcacccttcactggattacgcactgggattgtcgcggctaaggccttgtctttcgcgaccggagcgcgtctgctggggcaggacatcctctcggcgcaggcggcgtggacgtataatgggagggatcaggtcggcttggttgagtcggctgtcagacggctgacgctggcggtcaacgatgctcgtcggcgtcagctttactttgccttatacgaccaacccgaccctggatcaggtgcgcctgggaagccgctgatcagcatggacatcgaccatcccgaccgcatcgttgagcgggtcaatcaggtatgcgcggacctgctggtccaagaacccggaagggcggtccaagtggatgtggctggacgcgggttggaccggtacgagagcagctggcaggccctggattacgtgggccgggtggcgcaggacgtcattttcgaaggaggggccgaaggcttacgggtcttcgctcgctgcgcgctcaggcagcgcgaaccacggcctgtcgaacccctttacttacgccgtcctgacgtctcggtccctaagccgctcaagcgcgtgatgggggcctgatgtaccggcaggtggaagcgcccgacttggacgccctggtgacccttgagaagacggtgttcggcccgggtgcctggactcgcgggatgcttgagcaagagctcaacgcgccggcccggacctatctgctgtacgagcaggatggcgaaattcaggcctatggcggtttttggcatgatggcgcagacgcggagttgatgaccatcggtgtgcgcccggattgtcggggcgcaggcttgggctctggattattgtcgcgcttgattgaccaggcgcggcaccagtcggccgccagaatgctcttggaagtgcgtgtcgacaatgagcccgccttggccctctaccggcgtttcggcttccgccgactgcgtttgcgcaaacgctactaccaacccgaggggattgacgcatatgccatgtcggtggatttgcggagccccgccgtgagcgggttgccggtgggccacgagggcgctcaggcacggatgggccagacagacaagacagggatgggacgggactatgagtgaagcggtggtgctggggatcgaatcgacctgtgatgagacggcagccgcagtcgtgcgcgggcgggaattgctgtccaacgtggtcgcctcgtcgatgaacgagcacgcccggtatggtggggtgattcccgagattgcctcccgggcccatgctgaggccttcgtgccggtggtaagccaggcgttatcggatgcccggatggagttggcggatgtggacgctatagcggtatcggcgggtccaggtttggctggttgcctggctgtgggcgtctccggcgctaaggctttggcctgggcggccggcaagcccctctacgggatcaaccacgtcatcggccatatagcggtcacccagcttcaattcggcgacttccccgaaggcacactggctttaatcgtctcagggggtcacacctccctcctgcatgtgcgtgacgtggcgcggcaggtggatgtggtaggcagcaccctggatgacgccgcgggggagtgctttgacaaaatcgcccgtattctaggttttccctacccaggcggaccgcacatcgaccggcatgcgcaaaccggcaaccccaaggccatccgggtcccacaggggctgacacagggcagggcgggggcggagcacccttacgatttcagcttctcgggggtcaaaaccgcggtcgcccgctgggtggaggagcaggaggacgcaggtcgtcctgtaccaattgacgatgtatgcgcctccctggccgattcggtagcatcggtattgtcccgtaaagccctggacgcctgcgagctttacggttcacacagcctgattgtaggtggcggtttcagcgccaactcccaactcagggccaaactagcgcaggagggagcggagcggggcgtgcaagtacgcattcctgaagttaagctctgcaccgacaacggcgctatggtcgccatgttggggtccaacctggtccaggctggcgtgcgtccatcgccagcgggtttctccatcgactcggtcatgcccctgtcgaaaatctgcatgtaagccggttgttatcgcgctgatcgggccggggggagagggggccaaggaacaatacgttgccaaagtgatgttctgttgtataaaagtactttatgatataaagtactttttatcgggggatgttcaattgatgacgcacaacagaaaggcagcacaatgacgaagttcgatgaagccaaccattgtccaagcgtggccggcgaccctgaatcaatcagcgatcccgccaccgctatgcgcatcatcgcaagtgaccagtccaagctgaacgcccggttcgccggccgaaaacaggtgatcttcctggtctgggggctggcatggctggtgggctacctggttctggccttctcatccatgacccaccacggggagccgcaagggtgggcctacgtcctgttcgccatcgcgctgctttgcggagctgtgctcttcgtggccttccatgtccgggccagtcggggatggcgtgggcaatcgcagctgaaaggcgcagcctatgcctggtcctggctgttcgccttcgcggcgggcatgtcgatttgcggcctgatcgtagtgcatttcgacctgagcgactcgatgtcatggcttctttacaatagcgtggcggctttcatcgtcggcctgcaatatatggctggcggtctcttaggcaacttcgacctgcccatgtaccttggcgggctcttcatgctggtgctctcggtcgccatgctcctgctgaccagcaccgtgggcttcttcgtgatggccttgctgggcggaggcagtttccttacgctggctctggttgtgcgcatcaactcccggcggcacagcacttccggggttgagggtgggcgagcatgagcggggatcttgatccggtcatccacgccgcctcgcgtttgcgcattatggctgtcctgtcccatatggaagcggatggggagatgtcgttcgagaacctgcgtcaactgttggatatgaccgcaggcaacctctcggtccacgcgggcaagcttgagcaggccggttacgtgcgcatcgccaagaccttcgaaggccgtaagccagccacctacctgtctttgacggacaagggccgggccgcctaccagaactacttgctgcaactgcgcgcgctgctgacaggggaaggcaccgcaaagggcgagtcggaggggtgaagtcccggcggtccaggtacccaggcgtctggaccgtatccttccctcccttggcgcccctgacccatccgattcgacacgccaagtttgcggaagggcgggcgctccgctactatacataaattgtgttcagcgaaagttgaacgccgcattcccgcgtagctcagttggcagagcgtctgactgttaatcagaatgtcgctggttcaagcccagccgcgggagctcgtctcctggagagtgattggttctccttaatttgcaggtttcctgcctccttgtgaagtttcatacgcattcgcgtaagccctccctttggaaccgtgattcgtaataggcttgtagtagcccttgcgcggtgttgacgatgacccgctccaaggtattccaagcagactgacccatctcgtctgccccgtacaggaggttgtgcatgtcaaacggaacgactgccgaaggcaggatcaacgcgggcgacgcggtattgcgagttctggagcagtggggggtgccgcgcatctatggtcttcccggaggctctttcgactcgatgatgaatgccctccacaacgagcgcgagcgcgtggatttcatccaagttcgtcatgaggaagcgggcgctatcgcggccgccgccgaagccaagctgactggacgcatcggcgtctgcttcgggtcctccggccccggtgcggcccacctgctcaacggcctgtacgacgctagggaggacggcgtacccgtcttggcgctcgtcggcgaggtgccccagcaattcatgaacacggacttcttccaagccatggacgaagtgccgatgttcaccgacgtggcagtcttcgacaaggccgccaccaacgcccagggtctgcccgtcctggttgatgaggccatccgccgcgcttataagtacaagggcgtctcggtggtcatcatccccaaggacctggcctgggacgacatcgtcgatctgccggtggccaccgcgaagaacttccgcgaaccggctccgattccgccccgccccgatttgattcaggaggcggtcaagctcgtccagtcggccgaacgccctctgctgtattttggtataggggccaaggacgctcatgacgagctgattgaaatgtcagagaagttcaggatgcctctgacttcaacttttcctgcaaagggcatcgtagaggacggctacccggcttacctgcagtccgctggccgcgtagccacaaaaaccgccaatgaggcccagtacgcctgtgacgtgatgctctgggtgggctccgacaaccccttcggctcccaactcgtatcgcctcacacaaggatcgttcagatcgacaccgacggcgccaagttgggcaagcgctttgagcccgaggtggccctggccatccaagcggacgccaagctggccctgcgagcgattttggacgccggtcaggagcaggagtccaagcccttcttccgggcctgcatcaagagcaaggagaactggaacgagtggatcgactccttcaaggacgatgcctctaccccgctacgacccgagcccattttcaacatcattaacgagcagatggaggatgatgacatcttcatccccgacgtgggcaatgtggacatcaacttcctacgcctggccaagatcaagccgtccaaccgttggtgcgtctccggcaagcacgccacgatgggcttcgcggtcccaggcgctttggcggccaagctggagtacccggattccaccgtctactccctgtcgggcgacggcggtttcgccatgctgagcgaggaggttctggcccagctcaagtacaacgcgccggtcatcaacgtggtcttctccaacgagtccttgggcttcatcgaggccgagcagctggatgactcccatcagcccttgtctggcgtggacctgccggacacggactgggccaaggtgggcgagggctacggggcactgggcttcacagtgcgcaccctggacgatgctaaacgggcgttcgccgaggctagggccgccgacaagccctcggtcatcgacgtcaagctcacccgcgagcgtccattggacacccgctacatgcacttctccgagacttgcgaggatcccgagcaggttaagcggttccaggaccgtctgcaggctggttcgctcaagtccctggcatactggatggcccaggagagcaagtaagtgctccagcggcgtgagcgcttatggaggggggagggttacctgagccgatgagtcggccgaaccgagtgagggccccggtccggtcggcttcgcctcgcgcggtttgtcgtcatcaagcccgcctgcgagcgggacctcggcacattcgaccacattgccttgtgagcctggcctccgccggctaccggggcgagaatagggttcctgaccggcggtcgtcggtctgaagcgcagggagcccattgtgatgagtgaatcggagtcaaaccgacggctggcagtccgccgccgagccatgaggcgttggttggcggtgcgtcgcgcgctcaggcttcgagctcttgccatggcgctgctcgtgctgggcctgggcctgctaccggtttcgcccctagcttcggcagcccttcctccgtccggttccccacagcggggagtggcaggggagggctccggagggtgcggtccagcttggctttggccgttagcgcccgccgatggcggcccgccaaggattcttgcggcttttgacaatccgtccaagccctggatgcccggtcaccgaggcgtagacttgcaggccgcggtctccgagcctatattggcgcccgaatccggtgtcatctcctttgctgggacggtgggcggcaaggatgtcgtcagcctcagaatagggggattgacctccagtttcgaacctgccacaacccagaagcccttggggagccgggtggcacgtggacaggcgttcgctagggtcgaaggcggttccgaccattgcgatgggcgctgcctgcactgggggttacgccatgatcgtaagagctacctggatccaatcgggcgaacccacgctcacaggatcgtgctgaaaccatgaccggtgagcgtctgctgggcccaaaataagcttatgcaacctcgccgtcagagcccggcatcggccagtttgatatagccggtgtcaatgagcgagctcttcaaattcgatgccgagacggcgagcaggggccgggacagcacgggaagctgccgcccttgccggttctgctggctgacgtattccaagcccgtcagtccttggcctgcgtttaagctgcggcagaccacagccagttcattggccaatccttgccggtcctcaatgccggtcatccactgccggcccttcacgatctgggggatattgtaggtgtaggcgccgtagcccgtgatgatcggccaccggtgttcgttctgcgaggcctcattggatcggtcccgtccctcttgatcgccctgctcgctggagttggagctgtcggagggtctggggtgcggaaccgcgtggcgttggaggtccttcttaccggtcatattgccgacgatgtcaccgatcgagatttcggggttgacgtcggcggaggagccggtgtaccccatgtcggtcagggcggagatcgcgccggaagcgatgaagtcgttcatggcgatgacaccatcgatgcgctggctcttgccagcagcctccgctttctccatccgagcggtcaactgcttatccgagatcccgatgtccgaacccgggtcgaacgccactgcgcgccagtcctgttcgctgctcttgccgtccaaaagcccggaggggctgatggcccgtccgtcccggaagtacggagccagcaccccccatacccccttgaaagcatcctgggcgaagcggtcggccgaggcgttggcctgtgggtcctcccgatcggaagcgcttcgggggagcatcacctccactgcgcgtgggtcggttctgctggccttgtcgagctcaagcttgctaaccaactgctgggcctgcaggcgccctaccgcctcggcattggacatgcccaccagcaggtcgggcgtgagcgtgggcaggtcgctggagagcaagaccacgtgcatgccatccttttgggccagtttgagagaggataccagccgctggtaagcgttgtcctcctgctggcgctcgtcttccgccttgtcgccgctgccggggttttcggactggtcggttttcctggaacccgcctgttccttctgcggttgctggatggggtatccgacgtaatcgccgtactgcctggcaagggcatcgggctgggccgccggcgccacgaccagggttgtagcccgggccgccgccgacttggagggcgatggggcaccgtcgctgcgggcgcggtgggagaggtgggataccacgtagtcctgcacctgccggctctgctcgtccaggttcttgccggtgctggtcgtgacctggtccttgtcgaatcccagcttggtcagcgcgtctttgagctcaggggtgaatgccgcccacttgtttatcggtgtgtgctgggacagtgtaaggccgtcggaaggggtgaaaatcgccgccgcttgcgtcgtctgcgtgctggcggtcggctgcttgggggaggcctcaggggccggttcgctccaggagcaggccgacgcgctgaccagcaggcacacgcccaccgctgcgcttaccgttttggtgaccactgcttgtgcgcgtgtgagctccaccaccgctccttcgtatgtttcgtgtgtgcgcccctaaccaccgagactaggcagaggcgggctgacaggtccccattgtatggccttgcatccacatgcgcacactccacagggctgcgcttgccgctggcggagcatgcttgcgaaactgatggcgcgggccgtgaccccaggatcggccacatggagagaaagtggatgctatgagcgaagcggtttctggccgagccgggcttggccctgtgacgatgtcccatcctgcgcaatgctggcccaagaggcagggctccgaccggatgtccatacggacctccatccccataggcggcgggacgggactgacccttccggtgcggtacgtggacgccgaactggcatggaggcccccggacctgtccctggtccactccctggcaggccaggcctccttgctcgcttgcaaggccttcgatgtggcgcgtgggcacttcgacccccgcttgttgtccggttcgctcacccccacctgcctggagcgcctgaccttattcgcccgcatcttggagggctcggatttcggcagagtgcgaaaggcggatttcggttggtccttcccgccgatcgtgccgatggaggctgaattgttcgcggtgtggcctggacgatttgaagccgtggtatccctgtcccatgtcaaggagcacttccgggccaatgtctccttggaggcccggggaggcggttggatttgcaccttgctcgacctgggctgaatcaggccattgacgggcccaactcatatagttgagagtatgttgcgtgaatacaaagtcgaggatatgcatccgacgaccgacaaggacactatttattctctcctggcccaccgcgtcgagcgcgatccccaggacttgatcgcccagtggcaggacccggacagccgcgcctggcacgacgtgaccgcggggcagatgcaggagcgggttcgccaggtcgccaaggggcttctggccctgggcgtgcgcaagggatccatggtcgtgatttactcggccacctgctatgactggggggtcaccgacttcgcatgcgcagcaatcggcgcggtctcggtgcctatctacgagaccgattcgcctaagcaggccgagtcgatcgtcaaggatgtggactgcgtcatcgctttcgccggcgacgccgaacacgcccaggtcctggagcggctgcgcgacgacctgcctagcgtcaagtatgtcttcaacttccaggccgagggcctgaacgccgtgtgcgatttcggccagtcggtcaccgaccaggaactggaccaggcgatctcccaggtgagcgccgacgacctggccacaatcgtctacacctcgggctccaccggcaagtccaagggcgtcatgctctccagcaggaacttcacccatatcgtgttcgcgggctgggaggtcctctaccacatgctggcggcccccaccaggctcatgcttttcctgcccctggcccattgcttcgcccggtacatccagtacgtggcgatcggcgcccagggcgtagtcggttatgtctccaacacccgtcacctcctgacggacctgcgctccttccggccgacctacctgctggccgtgcccagggtcttcgagaaggtgtacaacgcagcatcccagaaggccggcactgggctgactggccgcattttcgctggtgctttccaacacttcgtcaactggtccaaggatgagcagggaggccgtggccattcgctgaccgcgcgtatgcaacactccttctatatgaaggccgtgggtggcagcattcgttcggccctgggctcgaacttgagcttcctggcttgtggcggcgcgccgatgaacgccgacctggcccacttcttcaacgggatcgacggcatcaccttcattcagggctatggcatgactgagaccgccgccccttgctgcgtcaacttcgaggacgccaatgaagtgggctccgtcggccggccgggccccggcatcgcggtgcggttgaatgatgacgacgagctgatggtcaaaggcccctgcgtgttcatgggctactataagaacccgcagatggacgccacggttaaggagccggatggctggctgcacaccggcgacctggcgaggatcgacgatcatggcttcgtcttcatcaccggccgcaagaaagacatcatcatcaccgccggcggcaagaacgtctcgcccgcgcctatggaggagaccatctgcacctgcccgatcgtctcccaggccgtagtggtcggcgacggtcgcccgttcgttggcgcgctcgtcaccctggatgccggaatgctgggcgcctggcttaaatcccagcatttggacgagtcgatgggggtggagcaggcctcgcacaacgatgcggtgcgggctttcatccagcagtatgtggaccaggccaacagcgatgtatcccgggccgagtcagtgcgcaagttcgtcatcctcgaccaggacttcactgaggaggacggcacgatgaccccctccctcaaggtggttcgccccaaggtcctggagcactacgccgacgtgatcgaccacgtgctttacgctcccaagcccgcaggcgccaagcccgcctcggcgccaaagctgcgcgtcaaggcgcccgaggcggtggctcctgtgctctccaaggccaaggacagcgtgagcgggtctctggctacggtcaccgaacgcctgcgtgaggccaaggccggtgagcaggacgaggccgagcctcgtcaagacagcgacagcgaccagcatgaaggggagtgagcgcggctgtgaccatccgagagattcgcgttgtgccggaccctgtactcagaacgccctgcgagccgattgagcgtatcacccctgcggtgcggcgactggtgaccgacttggtcgacaccgtcaacgacccaggcagggctggcctgtcggccaaccaaatcggtgtcagtctgagggctttctccttcaatatcggtggccgcttgggctatgtgatcaatccggtcatcgtcgagaccagcggcgatcagctgggcgaggagggctgcctgtccctgcccaatctctggtactcgactcgccgcgccgactacgccaaggtgcgcggcatcgacctggacggcaaagagatcacgttggagggccgcggcatcatggggcgtatgctccagcacgagtgcgaccacctggagggccacgtgtacatcgaccgcctggagaaggacgtgcgccgccaagccatgcgccgtctgcgcgcgcagagctaggcacgaccggggggtggggcgccccccggtcagccggccgctgaatgagaaccccttatgctatgttcaaacatgcgcgtcgtgctatgctttccacgctgtcacgggcggggagggctgatgttgactgaaccctaaccagacgcgcgaaatcgcgccatgcccgcgacgccctgtgtcggtcggcccatcatgggctgcatgcaggtccgcatggccaggaaagaaccgacaacgaaaggcaatacgatggcacagatcactatgagcgagatgcttaaggcgggcgtccacttcggtcaccagacccggcgctggaaccccaagatgaagcagtacatcttgatggagcgcaacgggatccacatcatcgatctgttcaagaccctcgaccggatcgaccaggcttatgacttcatcaagcagaccgtggcccacaatggcaccatcctcttcgtaggcaccaagaagcaggcccaggaggccatcaaaacccaggccacgagggtgaacatgccctacgtctgcgagcgttggctgggcggcatgctgaccaacttccagaccgtcaccaagcgcgtggaccggctcaaggagctggaggagatggacttctccgacgtgcatggctccggcctgaccaagaaggagctcctcctcctgagccgtgagaaggacaagcttgagcgtcagctcgggggcatccgcaacatgaaccgcaccccttccgccctgttcgtggtcgacatcaacaaggaggccttggccgtcgaagaggcgcgcaagctgagcatcccggtcgtcgccctggtggacaccaacaccgatcccgagaaggtcaactacccgattcccgccaacgacgacgcgatccgcggcgttaacctgttgaccaccctgatggcggacgcagtcgccgatggcctgttggagcgctccaacaaagctgctaagaccgaggaggccagcgaccagcctatggccgaatgggagaaggacctgctcaagagcaaggacggggacgctcaggcccagtccgagcaggctgcgccgagcgcccaagccgagcttgagcagccggccgccgaagccgcgccccaggcctgataaattcattcggacgccccgaccggtccgctgaatcggcggggcggagattagaggagataagatggcaacaatcactgctgcactcatcaagggactgcgcgaccagaccggtgccggcatgatggacgtcaagaaggcgctcaccgaagccgatggcgatgtggatcgggccaaggagatcatccgcgccaagggcatccaggccgccggtgcccgcgaaggccgcaaggcccaggaaggcctgatcgcctccacggtcgtcgatggaggggccggtcaaatcggctacgccatcgagttgaactcagagaccgacttcgtggccaagacccctcagttcgtcgaattcggcgacgaggtcatcgccgatgtggctaagtccggcgcttccaacgctcaggaagccgaggcagcgcaatctaaggacggcacggtccacgacacggtcgagcaggcagcggcactcttccacgagcacgtgaaggtcgggcagttcgccaaggtcgaaggccctcatgtggaggtctacgcccaccgcaagtccgtcgagatgcccccgtcgatcgtggctgtcatcgccactgatgaggctggcgcttccgtggctcacgaggcagccctccagatttccgcgatgagcccatcctggctgcgtcgcgaggatgtgccggcggatgtggtcgagtccgagcgtcgcgtggccactgagaagtcccaggccgaaggcaagcccgagcagatcatcccgaagatcgtcgaaggacgactgaacgccttctacaaggagaacgtcctgctggagcagcagtacgtcaaggatccttcgaagacggtcggtgacctcttcaggcaggccggtggccaggctgtcgcctttgcccggctggaggtaggcaagggcgaggagtgacgcggcgagttcgctcctgtcatagactttaggctctgagtcggaggaggagggccgtcccttagcgggggcggccctcctcgcgtacgcgccccttgtcgctctgagacggtaaactcttctgagatggcggcgcttggcgggccgtcatgattcaagctagaaaggctttctatgacctgctcccaggcgcaagacaatgaggcgggcggggctcgcagggtccttctcaaactctccggagaggctttcgggggaggcgcggttggcgtggacgtcaaagtcgtccagcgaatcgctcgggaaatcgtggcggctgtgcgctcaggtgtccaagtggccatcgtcgtgggtggcggcaacttcttccggggcgccgagctcagtcaggcgggtattgagcgctctcgcggtgattacatgggcatgctcggcaccgtcatgaactgcctggccctccaggacttcctggagcaggccggccaggccactcgcgtgcagactgccatcaccatggggcaagtggccgaaccctacatccccttgaaggccatccgtcacctggagaaaggccgggtcgtgattttcggcgccggcgcgggtctgccttatttctccactgacacggtctccatccagcgggccttggagattcactgctgccaggttctgatgggtaagaacggggtggatggcgtctacacggcggacccacgtaaggacccgaatgccaacatgttcgtacgcttgagctaccagcgcgccctggtcgacaacctggcggtcatggatgcctcggccctgtcgatggcccgtgacaacaacatgtccatacgtgtcttcggcctggagggggagggcaacgtcacccgcaccctggagggtgagcaactgggcacgctggtgtgcggtcaggagtccctgactcgctgagggaaaagccgcaagaatcgtcaaagacacaataaggagcgcaacatggcaacagtggtagaccaggccaagagccagatggacaagaccatcgaatcgactaaggagaacttctccggcattcgtaccgggcgggccaacccctccctcctcaacggcatcatggtggattactacggagcacccacgccgattaaatcgctggcctcggttgccgtccccgagccgaggaccttggcggtcacccccttcgacagctcgcaggccgccgcagtcgagaaggcgatacgtgactcagagctgggcgtcaacccgaaccgtgacggcaatgtcatcagaatcacccttcctgagctgaccgaggaccgtcgtaaggattacgtcaagatcgcaaaaaccaaggcggaggacggcaaggtcgccctgcgcaacatacgccgtaagaccaaggagggcattgaggcctccgtcaaggatggcgacctgggtgaggatgagggcgaccggcttcagaaggagctggacacgctgaccaagcagatgagcactcagatcgaccagcttctggagagcaagcagaaggagattctggaggtctgaccccagcgcctaaggcagggtcgtcggtagcattggcgagaaggagaccatgaatcagtcgcaggagcaggaggcggatcagaccctcgactccatcaatcggcgtaccggtcgcaatatgcctcaggccatagccacaggcgtgctgctggtgctggtaatcgtggcctgtgtcctgatcaggccggatgctttcatgctgctcatcgtctttttcatgaccttgggcctatgggagctgcgggtggatttcgccacggccggcatcgacctgccgattttggccctctggatttgttcggcggccaccatgctggccatgttctatagcagcgaccacgtggccgccatgatcatcggggtcctcttgaccgctgtgatagtcacgattggctcaggcttgcgcggccgggccagtcgtcggcttgagcgggcggtcctgggcaagcgcgaacaggccgacctgcccaagcgccccggagaggacggcttcggaagggatgctgctgcaggtctgggcccgcatgagcgaggaagccgctacattaacgccagcgtggcgttgttgaccgtggtctacatcactttcctggcttgcttgattgtgctgccaacgactttcgggcatccagttgcccacgccatgatggcggtcttcctgccggctgtcagtgacatcggcggtctctttttcggggcctggttaggcaaacacaagctttccccacggatttcgccgaagaaatcctgggaggggttgggcggctccatgctcttgtgcgccgtcgcctcatgcgccatcttcgcttgcaccttcccgagccggacctggtcgcagctctggttccctgccatctgcctaggcgccatggtaggtgtcacaggcaccttcggcgatctgagcgcctccctgatcaagcgtgatttgggcatcaaggatatgggtcatctcttgaaagggcatgggggagtgctggaccgggtcgattcgattctgatgtccgcccccttcatcgctgctttcctctggattaccggcctgtagggccggcatcccctcctggctgccgtccatcgccgcacacggtctggggtatttgaccgccggagaccagtgacgacggaaacgaacggcggtgcgtctcctatcgtccggaaactcccggtgtgaccgcgaagaacgccttcatagggcgccagggcgtcggggaaagccttcccgagtggattttacggtacgaccacctagtttcttcgccatcctgaacggttacggaatatgccggcgcatgaacagccttacccacaaccgcaggcctttcgaagacggttaggacgtcatctctttcatcgtagtcagggagccgcctaacgtatctacactgtgaccccgacccctcttggacgccttctaggaagatgagattggccttccataaggcctctccgctccacattgcgcccctggtctgtgccgtggcgtcgtggtctataggcctgggggctgttgcctgtaggattgcccgggtggacgcatgacgcccggtttcgccgcagcttgcggtgtccgtggaggcgtgcagttggccgagcgggtgaggaatcgttcaaaggatggtgcagatgcccggtgtggatcagacaggtgaacagccggagacaggactgacgccgggcgccgagcgaggggatttccgggacgtgctggcgcccaatcatgctcggaggggcaagccgcccctgcacttggcggacatgacggacgagcagcgcatcgaagccgcgaaggagctgggcctgccgcgtttccgcgttcggcagctcgccaaccactacttcaatcatttgagcactaatcccgccgatttcaccgactttccagcggctgcgcgtgacgatgcggccagaaggttcttcccagagttgatcaccccggtcaccagtcaggtggccgaccagggcatgaccgtcaagaccctgtggagactgtttgacggctccagcatcgaatcggtcctgatgcgctaccccaagcgggtcaccctatgcatctccagccaggtgggatgcggaatgggttgccccttctgcgcgaccgggcagttgggattgacgcgcaatatgtctaccggcgagattctggagcaagtgagggccgcggcggcggctgcgcgtgacggcaagctcactagagggccagcccgtctgtccaacgtcgtcttcatgggcatgggggagcctatgggcaactaccgctcggttctggcagcgatccggcagatcagcgccctgcccccggagggtttcggcatctcagcgcgaaacatcacagtctcaacggtcggcgtggtccccggcatgcgcaaactggcccaggaggggattcccgtacggctggccctctccctgcacgcaccctcggacgagctgcgcgatgagctggtgccgatgaaccgtcggtttaacaccacgcaagtgctcgatgccgcccatgactactatttggcttccaagcgtcgggtcagcatcgaatacgccctgatgaaggggattaacgaccaggccgaacatgcccggctcctcgccaaacgcctcaaccattacggcgacgactgggcccacgtcaaccccatacccctgaacccaatcgagggatcgcgatggactgcttccaagcccgaggatgagcgtcgtttccttgaaatcctccactcggcgggtatcgcggccactctgcgtgacacccgaggctcggatattgatggggcctgcgggcagctggccgctaaggcaggccaagcgtccggccaatcgagtgaaccgagcgcgtcgggtacaccgcggaccgacagttcacccgttgctgcttcggttgcccgcaaggcctaggatgggaaccatgacgaccttcgcttacatcccctctccgccggtctccactttctccatcggctcctttcccattcactactatgcgctgacaatgatcgccgccatcgcggccgccgcctgcatagccggggcgcgctggaagaagatgggcggcaactacgaccaaattctcgacatcacaatctgcgcggtgccagcgggcattgtgggcgcccgcttgtaccacgtgattaccacgcccgaacgttttttcggtccccaaggcaactgggtgaatatctttaacctgcgccagggtggcttaggcatttggggggcggtcctcctgggtggcctagcggcttgggcctggtgccggcacaagcattacccagcggccctcctatgcgacgccgctgctcccgccctgctagtagcccaagccattgggcgtttgggcaactggttcaaccaggagctttacggagctccaaccaccctgccttgggggctcaagctcaacgagacaggcaactcgatcggctcccaggagcagtgctacgacggcgccacttgcccgaccggtactctcttccaccccacgttcctctatgagatgatttggaacctgattggggccgccctcctgatttggattgggcacaaggccttccgccagctcaaggctggagccctgttcaccctctacatcatgtggtacacggccggtcgcacttggatcgagtacctgcgcatcgatttcgcgcacgagattctcggcctgcgggtcaacgtgtgggtctcgatcctggtgttcatctgcggagcggtcgccttcgcgatggtcaacaggaggggcaaaccggtggatctcctgtccgagaagctccgaaccatcaccgaattggaggagcgtcgcgcggtcgttcactccgcataagatggaaaatatgagcatccagatagcacccagcatcctgtcggcagacttcgtcaacttggaacgcgacttgaaagcgatttccagtgcggacctggtacatgtcgacgtcatggaccaccacttcgtacctaacctgaccttgggcgagccgatcgtggagcgtatatgccaggtgagcgaccttccggtcgacgtccacctgatgatcgaggacccggaccgttgggccccggagttcgccaaactgggcgcggcttcggtcaccttccatatgggcgccacgcatgctccggtccgcctggcccgtcagctgcgggagatgggcgtcaaagcctgtttcgcggtgcgaccggccgagcctgtggaacctctgttcgacatcctggatgagttcgacatgattctggtcatgactgtagagcctggtttcgggggccagaaattcctctccaaccaaatgggcaaggtccgccgtctgcgtgaccggatcaccgagctgggcctgcctacgcgcatccaggtggacggcggtgtgagcgttacgaccgctcctgtggtcgcccaagccggggccgatgtgctggtggctggatccgcggtctacggagcccaggaccgggcccaggcgattgactcgattcgtcgggccgcgcagggcgcttaccgctcctgacgggtggccaggacctttcatggcagagtccgagccagtgaggagccggcgatgagtcacccgattatcgagcgtttttcgcgcagcaagtacagtcccgacccgcgtgacgtgatttggactgtgcccaacgtcatctctttcctacgcattctctccatcccggtcatcgcctacctggtggccaggcgccatctgattatcgccttggtcgtcttgttggtctccgccctttccgacggggtggacggcatcatcgcccgtcgtttcaaccaggtctccaagcttggccaaatcctggatccgatagcggaccggctgctgatcctgtgctccgtcctcgcgctgtccatagcgaacatcctgccctggtggctcttgattctggtggggctgcgcgacgtgctgatgggcctgcaggtcctgctcctggcccagcacgattacggccccttgccggtccacttcgcaggcaaaaccgggacggccgtgctcatgctggccatacccgccttgattctcgcggatgcctggcggacccacttcttccaagtcctccacctggtggccttgggcgcggtgatttggggggtcggcctgtattggttggctggcctgatatacgctcgtcagggattcggcttgctgaaggaggatagccggtcatgagtgagcccagcccgcagcgagcctccttccaagtgccgcccgagcgggccctcattcatcgccgtgccgttttctctaaggccacggcccgtatcggctcccactttgttgaggaagacgagaccgccagaccggcaccagggcgtaagcgtcagctccaagatgaatctttgcgcctgattgatgacttgaccaaccgacctatggatccactgttcgaggatgccaggttgacgcctcggccaagccgttcctccctcgctctgtgggtcaaccgggtcgtcgtcttcctgatttgcgcggccgttggcctgggggtggcgtcggtggtccaggtcctgcatagggaccctcggcagaaggtccgggagaagcttatttctcagattcaggacgtatcccaacgttccgacaacttatcgggccaaatcgacggtctgcgcggtcaaatcgaccagctttcggccaaagtcggcgctgggggagcggcagggaacgggtcggccagtgatattctcaacggatcggtggccgtgcacggaccaggtgtcaccatgaccttgtccaaccccctttccagcaaagacaatgacaagggcgatcaaaccaaggtggtcaccgactcggacctccaatggttcaccacccagctgtggtcagcgggggccgaggccatcgcgatcaacggccacagaatcggcgcccagacctccatccgcctggcgggccaaacggtcttgatagggaccgactcggtccaaagcccctaccgtatagaggccatcggcgattcgcgcgctctgaagtcccatttcgacgagggggatcagcgcgattacttgtccaaactacgcgcagctaacatcacactccaggtttcatccgccagggatattacactgaagggagcgggggtgccagatttgcaatacgcgaggaagggcaggtaacagtcatggccgcaattctaggattgattgtcggcatcgtagccggcgtcttcctgcagccggacataccggtgaccctccagccctacctgccaatcatggtcgtggccgccttggacgccctgctgggcgcggcccgatcctactttgaacgctccttctccgaccgcgtcttcgtcgtctccttcttctcgaatgtgattacggccaccctccttgtcttcctgggcaatcagctgggtgtcggctcccagctttccacagcggtcatcgtggtcctgggcatccgcatcttctccaatgtctccgccatccggcgcttcattttcaagggctgagcgccgatgaaattcaacctcgccaaacgcccgggacgtacgccccctagcatcccacccggagcccctccggcgccaggccggttcagttggagaaaaggcgatgacacacgcaccggttccttcccagttgtgcgtcgtaagcccccgcgcgccctggggtcaagggccacacgggtcaaggttctgaccagtctgctggttgccttcctctgcgccttgctgggtttcggctacgccgtccaggtgcacaacaccaaatccacttatgagggattgagcgaggacgagctggtgcgtctcctggacgagaccagcacccaagtcgacaagctggaggagcgcaaaagccagttgggcgagcaactgcggtccattcaatccgcggcggacaagcagcaggaggccgctcgaatcgccaagcagaacgagaccgcctccggcattctggccggtcacctgcccgcagagggcaagggggtcgagatttcaatccaggaggggaacgaccgggtggacgcctccaccatgttcaccttgattgaagagctacgcaacgccggcgccgaagtgatcgccctcaatggcgtgcgcgtagtcacgtccacctacgtgaaggacagcaaggatggggtcgtctgcgacggccacaatctgaccgcgccttaccgtatccagttccatgcgcaggtatcagttacccagtctaacagtgtcagaattgaccagatacggcaaccgcagcactatcagtacgctcaaacggtacaataggtctttatgacagaaccgattcccaccgcgggcgaaacaaccatcatcggcatgcccgcactgcacgtacccgttacttcgaccggtgaccgaccgctcacccaagaggacctggacaccatctcccgactgggtccgggcacggccctcctgatttcgacgcgcggcgccgtctccggctcacgctacctgctcgacgaagaccaggtcagcgtaggtcgagaccctaaggccgacatcctccttgacgactccacggtctcacgctcccatgccgtgttcgaccgttcaccagagggctatacggtccgcgacgccggcagcctgaacggcacgtacgtcaaccgccagcgggttgatcaagctttgctgcataatggcgatgaaattatggtaggcaagttccgcttggtctatttcacccgatcagcgattgtcggttagcgggggaggggttcgcccccccccatcacaagtgatttgtaggcgtttcagggggattgaacttccgattggttcctgcttctcattttcgcttacactggattcatctaggggagtaggcactcacgaaggaagaagagtgatgagcgttaagaggggaacaagcgcgccgaacggaaccgggcaggagagggttcaagctatccagggcgaactgttcgccgccaccggcgacgagcccgtcacacggggctaccggggttcggtcgcctctgaggtggctggaatcacctataggcagctggactactgggcgcgtaagggaatcatggagccttcaatcactcagtcccacggctcgggttcccggcgtctgtactcctttaaggacatcgtgattctggccgtccttaagcacttgctcgacataggcgtagtgctgccgaatgcgaccgtggctgtcggcttcctttcccgcaaatccacccaaagcttggaggacgtcaccatcgtctgtgatggtgagtcggtcgaggattgccagagttccgagcaactattcgaaatcatgacctccggcaaagcggtctttgcaatggcggtaggctcaatctggcggcaggttcgcgatgacctggtcgacaaggattatgtggaccttgacgaggattccgtcttccaagggaagctgcgcaggccactggaagagatggcgattgaacgtttgcgccagcgtatcgagctccagcaggccgagcgccgtgagtacgcgccgctgcgcctcgcatgagcccaacccatatgcggttgttcctggcggagcattttcgtctgggcggttgatcacttgttcatttgatgactaacccatgagtgccttacgaaggggagaagcgcaatagcggatcgcatcctacggtggttcgcactgattgctaatttgacataacgtacattatcggcttttagggttttgctagaatcggaggctcgggagcgccgcttgcttggtctgtgctcaacgagcaaatccatgacaactgctgcgttcaaaccttggcggtcgccggcaggaagtattcctcaaccgcttgagcaagatcgtgcacgtgctcgatgactcggtaacagccgtgctcagctaactcgccggcctcggcgtagccccaaccgcatccaaggcagtcaagcccgacagcgtgggccccgtcagcgtccgtccaccggtcgccgaccatcaacgcctggtcgccggcctctgggttgaatcctaatgaatcgaatccataactgatgacttgatccttgcgaaccctggatgaatcctgggaagccccgaatacgtcatctaggagtggctccagtccgaaatgcccgcagatggacttagcctgcgcctcgggtttgcatgtggctacagacaggtggaagcccgctcggcgcagggcccgtagctgatccggcacgtccggaaacacggagttgcacagggtgcccgttactaggcggccagagcctgaagggtcctcgaagatcgccctgtcggtgtaataactgcggtagatgctcaccgcgcgcccaatgagcgactcgtcgacatggttgcggcgcagggatgcaggaatcgatggaccgatgaagcgtctgagctcggcctgcgaaggaaccggcagacccaagtcctcgaaagtcttcaccaccgacgcgatgatgcccggatgggatgccgtcagcgtgccatccagatccagaagcactatggttcgggcgtgctcgcctatttgtccttccgaggccattgagagcttcccgccttcactcgtagtcagggaaccagccttcacggcgcatcttcagacgcttatcgagcaggaccttgagctcatcctcggatcggcgctccatcaacatgtcccagtgcgtgcgggtgggcttgccggtatggttgacttcggtctcgtcctccccctcacggcgggcgatctgcccgcagcggcactcccactcgtcaggcacttcggcaccttcagctaagggcagaatcgtccggtgccccttggggcagacataggccacctcgcggcggggcgcaaagtccacattgtcgtcggactccaacgatttagcgccaatactcataccgcgaagactgcgttcggccatgcttcctccatgtatagggcttccagggacaataccactcccaaactacaaaacagctcggacctcgctcttattcccatcccggcgggtcggggcgttcaatctacacctgtataggcaacgatcccacggtttaccgcttgcaccgcgcggcgggccgtctgagcgatccccctcgagtgaggctccaaatagggctcaacctggatgatttgggtgagtacgtcagacaggcgcttggcgttacgcacgaaatcgcccgcggtcaagtcgctgccctgaaggatccgggccagactctctcccccggcccactcgtatatgacgccagccaagccgaagtccaattccggtagttcggtggctagaccagcctcatcacaggcgtccgccacttgcttccagatgccctccatgtcggcggccgcggccgctagacgcccctctggctcacctgggtagcggcccagctccctggtcagccctcccccacgggactcgtagaccagggccgacagcgcggcggccaattcgcgtggctccagctcatccaaggcaccggacaggagtgtctgcgccaggaccaagtcctgctcgctgtagattcgacgcaggagctgcccactctgggtcagtcggtaatcattgcgccaactggcttcgccttcagcgcccacccggtgttcgacctgcctcaagtaacccatgcgttgtaggatctggcagattctgtcaaattggcgggccactgatcccgtgcgcgaagcatagcggtctttggccaaaccgagttcgcgccgctcccgcagccagcggcgcgtccacttcaggtggtcctggaggtgggggcatccgcggcatggatgctcgcgttcagcctctttgagctcattgatcttgcggtccaccgcggcgaaggcctcgcgccgctccaaatcagaggcgaacacctggcgtttcagggcgcgtctgcctttcttctgtacgcacgacaggccagcccggatcagggcgaagtcggtgacatcgccgtagtcgcagtgagcggcctgttcgtagccctccatcgcttccttgagcttacggatttgcaccttcaactcggaggctgattcattcgcctcccactgggcgaaggagtgggccaaggttgtacgggccgtctcatagtcgctcgagttgagcaggttgaccgccatgttgaaggtagggcggaaggaggagtgcagggggtagacgcgcttgctcgacagggaggccatggtctccggcttgaacccttgatggtccacaacgatcgcatggcctatcgagtcgatcccccgtcgccccgcgcgcccggtcagttgggtgaactcccctggcgtcaacgccacatggcctgtaccgtcatatttctccagcttttccacgaccacgcaacgggcaggcatgttgatgcccagggccagggtttccgtggcgaacaccgccttgaccaagcccagctcgaagaggcgctcgacgacctggcggaagagcgtgatcacccctgcgtggtgcgctgctatcccctgctccagggcgaaccggaactgcgagtagcccagggcctttaaatcagcatggctcagctgcccttcgaccatgccgtccacaattcggcgaatgcgcagggcttcctcgtcggtggtcagtttgaggccagcgtccaggcactgcctgaccgcatcgtcgcaaccgttgcgtgagaagatgaaatagatgcctggcagcatccccaggtagtccaattcatcaacgaccgcccagcggcggggtgtatgccggttcggctgcctgacggactccgcccctcggcgtccctggccaccccgcctccgcccgggtcgttcgctccggcgggagcgcagggccaggtcgtccaactgcgagaggcgcgaaaccaggcgggggttgattttcgcgctctgcttgccggacttgtctcgccggtagagatcaatgacctcaggttcggtgcgctcgtcctcctgcacgatgacgtgctgctccaggggcaccgggcgtcgctccgagaccaccagttgtgtcttgccccgtaccgaggcgatccatgaggagaagtcctccacgttcgagaccgtggcggacaggccgaccactttgacagtgcgcggcagatggatgatgacttcctcccagactggtccccggaaacggtcggccaggtaatggacctcatccaagacgacatagcgcagggcgttcagcgtggtcgagcactcgtagagcatgttgcgcaagacctcggtggtcatcaccacgatgtcggcctcggagttgatggaggtgtctcccgtgagcagccccaccttgtcctcgccgtacaaatccaccaaatcgtggtatttctgattgctcaacgctttgatgggcgtcgtgtagaaggccttgacgttctgctcttgggccaggtggaccgcgaaatccgcgatgatggttttaccggcgccagtaggcgcagccaccaatacattattgccggcctccaaagcgtcgatggcctcaatctggaagtcgtccaagtcaaaggacaatccggcggcgaaccgcccggcggcgctggcggcccgatgctgccgggccttgaactgcgcgtagcggttagctgggtcctgaccgctttcttgctctgggcgcttgcgtgttcggccgcgcccccgcacggccccactgtcagcgtaaccagttccgtccgtcgcgggagcggcgtgaacatgacgtgacatcgggctctctcccccacaccattagttggacttgaaatgcctgtatcactgtatacagaccccctacccaaccgcctagtcgttaaaggtttgccatgacttccaagtatcgttgtggcgctcgcgggccgcctctttgcgctccagaaccttggcgtgggcgcttgcgtagcgatccgctgaagtcgacaagggttcggtgaaagctgggtcttgctcggggcgctccggggcctgcagacgggaggggcccaggcgctggctgctggcggcgacgagcgaacccacaacatgggccgctgatcgcgcacggcggaaaacgtaaattccaccagagaccagcatgacgatcatcaggatcactatggccagccaaatccaccagggcatcgtttcctccttcaaggaatcaggagccgggagctgcgctcgcccagcccgggggtcagtcctgcggttcaggcacgacggcggagagcgaaagctcgcgttgcgcacgtgccagaatcatcttacgcagggtctggggggccacggccgtaatatgccgggcgtgcgcaatgcagaaagcgacgaaccaggagtccgaagagacgatcaagtgaaccttctggccctggccgcaggtttcgactgtggcgccggacagtgatttgatgtagggcaggtcggttgcgtcagtgatgaagaccgctggcgtgccgttgtcgaagctccacctgcgcagttcggagactggcacatccgggaattcgaccttgtgttttggcgtcaccagctccgcgtgctcgacccgcgagagcctgaggacctgccactgccggtcgcggccggtaccctgcttgagccggggacgggtctttccggccttgccatcagcgcttgggtaggcgtccttttccgctgtggtcccttccgcggcgtcgccgatgtcggtccagaccgcagcgtaatacaggccttcatcgacgaagattttcgccggggccactactttgcgccgtatgcgccccgcaccgtcggtgtactccatgtcaagcagggaatcggtcttaatggctctttggaccagtgagaagcttggtggctcagtctcgtagccggtcagtgagagccagggggtctcccccggtcccacgtgcttgcgcaggcgctggtaaagggcctcggcctgctggcgggagcgttctggcagcagtggcgaatgggccaggtagttcagtgaggcggtcaacatgctcaaatactgcggggagatgccagccagacgctctaagcccagggagttggtcgccgaaacgacgcctgcctcgtccaacagggtccagtcaatgtcaaagaactgggatcccgccatctcgccgtcgtccgagacggtggtcagggtgttgatatcctggtggatggtgttaatggatttcttaagttcctcgggtccgctggccttgccgatgaagcgctcggctagctctgccaacgagaactcctcgcctaagtgggcggagaggaagagcataagcctcaggcgacggtccacttcggagccggtctggaaagcggaggaggatttgcgggggcgcggctgtccatcgccttcgccctcggcctcctccgctgcctgctggagccggctgatggctggggtcaccaccgtggccgccgtatcgccgatggactcgtcggcgagctcgaaattggtcgccgcgtgcagcctgcggcggaaggcgtccactgcctcctgggggctgacgatggtggcaccggggtgctccaggacgaacatggccaaatcatccgagtcggtgtaggctacgttcagcttctcgccatccacatctatcgtggccgcgaaccgcctggagtcgatgaccttgaccagcgagtccgggagatgctgggtgcccagaccaggtgcgattgaatccaagcctaggccaggaatcggcacctgaggcacgcggggtgtggtcctcgagactgggcgcgccggctgtgaggcttcttgcgacatggcgattgagcgggccaggtagttggccgcagccaggacaggcaggtcctcttggtcgaactgcatgcggattcggggctcatcgcccagctgaagccggtaggaggcgaagtcctggccctcggatttggacgagtactcgggctggcgggattcgatggcgatgcccatcgcggccagcttggcccggtccctctggaactgcttggcgaaggctgctttagcggcctgatcggccagctccccgtaggagtcggcataggccttgacccgctgagcgatctgccgggaagtgagccattgggggaaagcggatgacaatacggcgaggacatctagctcgtgcttgccccacttatccgagaatcgccgtctgccgttcattccctctgccatcagtcctcgcgtatcattaatatgttgttgaaggtgtgcgtgcaattgcacgcacaccttctatcataggttcttttacacgctgtgaaaaccggaatgttcaaatcggtctgtcttttcgtgtctagctgaccgcgtgttcatcagtcgggcggagcgcctagatccagtcgtccggttccaccccttgcggcccgatgaactgcccattgggcacgtatgagggccgccctgggtcctctaacttcgcgtccgagtacaaggtgacgtcgcgcccgaaagtccagtcgccttgaatggacaccgattgggccgcggccagcgccggcacaccgtaggggaaacgctcgttgaagtccgagatgttgcggtagtagcgctggtccagctgcacattggggaagatgtagttgccgtcctccatttcgtaagagtcggttaagtggaaacggtccgaacgcatgatgaacaagtcgctggtggttttgactggcaggaagcgcatacgatcgactttcacgcaggtggctccctcgaagagcgaggcggctgcccccatcgcggtctccagctggatgacggccggtgtggacggatcggctgggtccacggtcttcttgttgatgatgaccggcaggggcaggatcccctggtgctcctccagcttggccttgagcgcgtccacccgcacccagatgctgttggtgttgaagtaggggtgcttgcggatgctcatggccgaagccttgtcccgtgggtcgacctgggtcatctccctgagcagcaggcggccgctcttcttgtcaaccaccaggtggccacccttcctgtcggcttccgtgcgctgggccacctcgaccatgaagggcgaaccggactgggcgaagtgaccggccagggtgcgggaggggcgggcgcctaggttgtcggaattggagatgaagaggtactcgatgccctgggcctgaagggtgtcaagcaggccggactcccaaatcgtggagaaaaggtcaccatgccccggcgggcaccattccaactccgggttgtccgggtatgacacaggctcgccggtcgccaggtctatcttgggctcgctgtgctggatgatttcgatggggacctcgctttgcgcgaagttcttgttgcggtgcaccacccgtagggtgtccgcggaggtgcggaaggagttcatcagcgtcaacggcagtggcacgtccaaccgtttgcgggccgtgatgacctggcccaggatgatgtcgaggaaacgcatttgccgggctttgtgccggcgcacgggcaacaacgacttggccttctccaagcccatggaagtgcccagtcccccgttcagtttgaggaaagcggctttggagaatgcctccaaagcgaagtccatgtccatggattcgcgcacttgtttaaaggtcggcacgtctttgagcggagtcacatcatgctcgcggatgcagtggtccacatccccgtcgctccaggtcttatacatgtgttcgaattgcgcaatagccacgtcgctcatctgcttatcgtgcatcttcgcgcggcagtgttctaatgccttggaatccatcagtctcctcccttgcgttaggaccagtgtaatcgatggtcatgcggacggccaaaggcggtggatgcaagtgggataagctaactgcctgacgcgccgagcgattggcaagacctaccctgtgtgctacagtttttcttcggtgcttgtagcactgttcgggccgtagcgcagtttggtagcgcacttgactgggggtcaaggggtcgcgggttcaaatcccgccggcccgacgagatagcaaaattccaaggctttcgggccttggaatttttcgtatgccaccaatcggggtctacgggagctgaacgtgttgttttagggtttgggtatgtgcctggttgcgcgtccatcggatcctgctgttgggtgtctgacgggtgtgtcgaactcgttccgattgatggcgggaccgtagttgtcgggcccgtccgtctgctgtccggtcctttgttcccatgccgattgcggctggtggtgcttgtccctgatcaggctggtggggtcggggtcggcgcctctcatgtggcatcgccgttcgcgggcacgtcccatgtgcccctcgggctggccgtggcggttgcaggagggtgcgtttgatcaggcagttggggccaccctccagccggttggcggcgttccactgggcactttcggtcgggccgggttccaggaaggcgaagcgccggcccttaaggggcaagcgttccaggcgccggtagcgtcgcctcagctcctggcgggttcgtcgccaagagccgtttgcggacttggggttggttcgggtcgttcttggccatggcgcgttcgttgatggacctcttccgccgctcgtgccaggcgttgggggcctcgccccaccgggagcggggtgcatgtcagatcggccctggtgctgcgctgcgcgtgcactgggcagcgttgcatgcgtgtgccgagctagatggccccgcggaccttctgcgcgccgcgcaggccttcggcgatgagcgcgtccggctgcgggatgcgggagaagggggccgtgggcgcctcggtgttctcgtagtggcagcatcgccggtcgatggcctgtccgctggccccgtcagtcgctatgacccggcttcggcggtgggccatgtaggtgccgtgggccgtgaccgtgtgctgggccatccccgtgcggctcgatgacggggtatgctccggcgccagccgacctgtttgcgccgcgcccgggcccccgtgacccccgtctgttcctgtgccccgcccgaggaggcagccggtccaggaactccttccggctgggcggaccgcagacggtccgtgggccgtgcggtggacgtcagcgagcgggacgggcacatccgccgcggcgaacctgacgccgcgcgccagtgcttgcccatcggcccgcggtgtatcgggcaatgtctggccctcttcgacctggtccttatgcaccaattgaacgggacgccacgccccccccggcacctcccctccccatgaagaccccgggtttattgacgccatccgacacgaccactgccacaagcccaaactcccaacataaacaacacgttaagttcccataggccctaagtgcttagatttgtatttattcgaggaggaatgtaatgcagagaataagtaagagaggctcgtgtgacggatgccgtggtctgcagcctggctacaattgccggaatttagcctgtggacgtaccgaaggtggggacgccaaagacaccgattccactgtttccagtatcgacagcaagccagcaaagggcgttttgacgctttggcgatgggagccgaagggaagaagcttcctgagctggtcaaagactctgaaaaggagaactccgaacgttcatgtcaaagtgacctctataccttgggactccgctcacgacaagtttcagacagccattgcggctggcaatggtccagatttggcctagataatcaacacttggatggccgatttcagcaatgccctctcgaccgtgccaagcaacctctccatggatgacatggcatccggccccgttgagggcggtaaggtcgatgggtaagcagctgggtgtgctttggtatatcgacacccatgtcctctataccgcactgatctggcccagcaggccggttagggccacgctcccaagacctgggatgagctcagcgcaatgggcaaagacatgaagaagctggacggcacgcacttcggtctctacctgaaccctgctggaacggacaacttcatcgctgatcttccattcgctttttctgctggcacctcgctgaccgacgagtaaggtaagaggtggaccttgaacaccccggagatgcgaaaggctatcacctataccagcaatctcttcaaggaaggtattgcagatgtgaatgccgataccagtgcgggtaccaacatggccgccttcgcctcgggcaaaacctccatgatgatggaaggcttcactgccatcggccaggtggagcaggtaggtggtcctgatatggggaacaagttcaccactgctcctctgcccaagggtgagaaggagtcggtttcctattcgggaggccgcgacatggttgtattcaaggactctaagaacaaggatgccgcctggaagatgaccaagtggatgagcaagcctgagacccaggccaagtggtacaagctttccgccgatcttccgacctcgtccaaggcttgggaggatccggagctgaagaatgatgagaagctgacctcttttgccatccaaatgaagagcatgaaggctaccccgtccgtcatcacctgtgcacaggtcagtgcttcggtcgataaaatcatggagcaaatcaacaagggtgccttcagtgttgacaatggtctggaacagttccagtccgaggcggaatcagccgggatgggcaactgaacatgagtcgtaagcatccgtcgaaggatacgggggtgggcgttcgtcctcgctcctccgtcgtaggcggaccctcgtcgcatggggtccgccttgtccttcacccttgtcttcgtggttttcatgctcttgcccacttctgtcctctttgatgatgtcgtttaccgatatcacagcaagggacctcaagacttctttcaatgtcaactttgtcgggcttcagcagcacgcgacgctgttcaaggattcccagttcttgcggcccctcgatatcgccggcattttcgtggtggtctggctgccccataaccatggccctggcgctttgttttgctgtagcctttaataagggcgccaagcacttgaacagtttcttccgagctctgtattatgctctggtcgcgtccagtgtggtggctgtttcagtggtttggcgatatatcctgcaacgcagtggactgctcaacgacgccctggccctggtcgggattcagggcccggattgtttgcatgacatccgtttctctctgccagctctgattgtcatgaccacatgacgcaacatgggtaccctgatgatcatcttccttgccgtactccaggccgttcctgaggatgtcaaggaggcggcggccatagatggcgcatccaagacgaggacattctggagcatcaccatgcccctcctgaggccgactctgctcttgggggccgtgctcctgttagtgacctacctgcagttcttcgaggaatttttcgtcatgacccagggtgggcccctgaactcggcactgtccgcttcctactatgtctacccgcagttcagcttcgggcagtgcggcttgtcatcagcggccagttacatcctcttcatcatcatcgccttggtcagcgccctgcagttccgggtgctccgcacgcaggaatgaggcaatcatgacttctgcatattccggttctgctcaagcgggccggaccaagccctccctatggaagaggtttatgaggggacgcagtcttacctatacggttctggccgtggtcggtttggcctggatattcgccgtcatatggatggccttgggttcgattaagggctagggggagatcctctctacccctcctactttctggccggagaactcgacggtggagaactatgccaagtggttcggacagctcaactttgtgacctactttgtcaacagcatgattgtagcggtgattacggtcctggggagcgtggtcttctgcttcatggtcggatatgcgctggcaaagatggatttcgcgggcaaacgcattcccttcggtgccgtcgtgatcaccctcatggtgcccagtgtcttgacttgtgtaccgctctttgtcattgtgtccgacatggggttgcccaatacctattgggccctgatcctgcctttcctgacccagcccattggtgtattcctggtgagacagttcatgatggggattccggatgcccttctagaagcggcccgggtggatggtgctggtgagctaaggatcttctggtccatggtccttctccggtgcgagctgccttttgcaaccctgagtattttgaccttcctatcctcttggaacaacttcctgtggctattggtcgctatgcagaccaacgatcgttataccttgccggtggcgctttccttgtactcgacagggcaaaacgccaccaattatggagtcttgttggcgggcgcggtttggtcattacgccgattctgctgctctttgtagccctgcagcgctacttcatccaaggtgtagctatgaccggcatcaagtaattccagctttccatgcccaggcttgcctctggacaatcattggaccagagaggcccctgcccatcgtcgacggtgtagagcgtatcctgaccggctgcgagttttacccccaatccgtggaacacgcagtccaccatacttgggatgtggctgaccacgttccggtagtggctaccggaaacaggattgccatcggtgacgactctcggcgcatcgaatatgcatactatgccttggctgggctccataaggccatggacgatgggatagacatgcggggctatctgcattggtctttgctcgacaactacgaatagagctcggttaaacccacctctggtttggcttcaagcgatcctgacaccttcgagaggattcccaagccttcaatgaagtggttgggcagagttgcgcaaactggtgcgctgagccatccttgagtcgtccaccatcagggaagtaagttatatgtggattgcctgtttgttgatgggttggttgcttttggattgtcaatatctccaagctgtggttcctgccaggaagtgcatcgagtttgacctgtctcgatcattgttcgggtccagattttccgtaggggcgtgaatccgaattgattgctcatgctgtcatcaattcgggttctgcttttaatctgtggactggttcaggtaaacggtatgtttgttccccccccccactggactgtagcgacacaccaagctggacgccagcgtcaaatggtgtggctaatgaggaggaccgtcacgtccaggctgtggaacggttgaccaagtatgtcatgtcctgaaattaggtttcggggtcaggggggcatcgcccatacccgagcgcgtggcaatatcgaatacctgctccgactatcggatacgactgaagcctgccccttccctattcgtattgacgggatggcctgtttcgtatcgtttcggagcgattccgcctaagcggcggataagcaatgatatatttggtcatgctcacttcccctttccccaggaggtctcgtggctgggattaaggatgtcgccgctgaagccggagtttccatcagtaccgtttcatatgtcctctcgggaaaacgacgagtcagcgatgagaccaagttaaaggttcttgaggctgctcgtctcttggattaccgtcccaggcggggggccgccatgctgcgccaaggggcccggaccaggttgatagcactgagttcccccatgcacagctacaccgactacagcaactatgccgcatttttcttcgccgttgtaggcagggcgcgtcgctaccactacaatgtcgtgctgcttatggatgaaaacgaggaggatgaactgctgcggatgtcgtacagcggcatcgtcgacggggtactgctgctggacgtcaataccgacgatgagcgagtggctcatgcgcgaacatccatggtgccctatgtctctatcggttgcgcgaaggatcatgcggaccttgtttccgtggataccgatttcgaggccatgggaaggatggccattgatgagttctaccggttggagcatcggaatgtgctcatgatcggagccggtgaagaaagctaccgccaaggatcgaacttcctggtccggaccagggaatccgttgaaatgcgagcaaaggtgctgggaatgcacctagacttccaatactccaccggcgatgacgcagtgcacgtggaggaggtgattgcgtcagcctacaagcagaccccgggcataacggcgattatggcccaaaccaacatcagtcacatgaataacgtcatcggttccttgtccatacgaggcaagtccattcccggcgatgtatcgctcctagccttgagcaccttcggcaacgcttcggtcatggaacagcccatagatgagattcccatgcagcccaaccagacatgctcccgcggagtggacatgctcatggatcgtattgaagggcgtgaatccagtatcgggacggttgagctgattccttcgatttaccttcgccgaggatcggtcggcccagttcccggtagaggctgaacggcccgtacctccaactgaaacgacttgtcgaaaaatgtcgaaatagtcggccgatgatagtgccataaatatattaagtacaggttatacatcgcggataacccttgagcaatgaggccgaaaggagaagactccaatgaaggtgtctaaaaaaatcatggcggcgacaacagccgtggcgagtctcgtgggacttgcatccttgtctggttgcggcggcagtaacagcgcccaggaggagcgccctgattccatcaagatctggtactacgaggaggataccggcgcacagggcaaagcctggaagcaggccatcgccgattaccagaagaagaccggagtcaaggtcaacttcgagaagaagaccttcgagcagatcaggcagaatgccagccagattctgaattccgacgatgcccccgatgtcatggagtataacaagggcaacgccacggccggcctgctctcgagccagggactgctgtccaacctgaacgactacgtcaagaagtacgactgggataagaagattaccggatcactcgccgcccccggtaagtatgacgagaagggcgtcatgggatcaggtgattggtatggcatcaccacctacggcgaggacgtgatgatgtactacaacacggacatgttcgaaaagtacaacatcgccattcccacgaccatgtccgagctggaagcggccatgcagaaattcaaggacaacggcgtaacaccgttgtccgagggcgtggctgagtatcctttgcagcacctctggtggcagctggtcctgcagaaggcggataccaagctaatcaacgcctaccagcgctatgacggcaaggtcgactgggagggtcccgctatgacctatgccactgacaccatcaaggactgggtcgacaaggggtacatcagcaaggactccaccggtctcaaggcagaggatgccgggcagaacttcatgaagggcacctaccccatgttcttctcgggatcatggtggttcggacgcttccagaatgatgttccaaacctcaagtggaaggtcggtctcttccccgaagccaagaagattcctggcggatcaggtaatatctgggttattcccgagcgttctaagaagaaggacgcagctgccgagttcatcaacatgaccctgagcgaggaaaaccagaacttgatgggcaactccggtggcctgcccatcgccgctaattccaataagatagtcgatcccaagagcaaggaactgatatcagggttcaacgaggtcatcaaggatgaccgtctgggttactatcccgattggcccacttcctcactctatgacgagctcgatgccggcctgcaggagctggtcaacggtaccaaggcccccaaggacgtgcttgaggaacttcaaggcaagtacgacaagggtgttgagacgtcaggcgtgaagcagaagtaaacgcaagatcgctcggattacccgatcagtcgatctgagcctggttttattcaccaggtagtcccgcagcgccggtcaacggatcagctcccatcagggagtggatttacggccctgcgggacatcactcggacatcatttgtgtatgaggaagtgaaacatgggatcacgaagaaagaaaggcgccaaatcggtctccgccaggaccgaggaagagcgcgggatgtcccggataccgggtaatccgtctaaccgcttctggttgtatctgataccaggcctgttggtcctgctttggattattatcgtgccggccatctggaacatctatctgagcttcaccagctaccgaggcatacgtccgccgaagtgggctgggttggataactggtccagactcataagggatgccaccttctgggcttcctttcgcaactcgatctggatgattgtggccatggtggtcattcccatcctgattggtctgattctggcctctctggtgttcgacgtggtgcagaagcgtttcggcgccaagaccgcttcgaccatgagggccatctattacttcccccagttgctgcccatctccgtggccgctcttgtcatgggctggattttccggccagagaacggggcactcaatgccattctgaaggggataggcctggggcgcttacaacacaactggctgggatcgcctgatacggctttgatattcctgatgatcatcatgatttggattcagctgggttatccgttggtcatcttcatgtctggtctgcagagggtcaatccggaactgtacgaggcggccagtctggatggggccaactggtggcagcggttcaaggtcatcaccctgccggccatcaagcccgagattttcgtggttgccctgacctgcaccatcgcagccctgaaggtcttcgctcctgtatacatgctgaccaagggaggccctggcgacagcaccatcgtgccctcctattactcctatacccagttcttccagtcccagcaggtcgggtacggagcggccatagcaactgccctgacggtggtcatcatcatcatatcgattgtcttcaccaaccttcagcagcgagttgagaaagaggatgaggagtaagacatgagtgcacataccacgcttcccaaagcaaggaagaaccggacgatgggagactgggccattctggtcctgctgatcatcggcggtctgatcatgcttttccccttcttcatccttctcctcaacgcctttaagaccgcggccgattacaacgcatcaggcccgctctcatggcccagcgaattcagcctggccggcctggagaagttctggaccagggtcaggttcccccaaaaggtttggaacagcatctggatcagcggactggtgtcggttctagcggtcggtctctccgtgctgaattccttcgcactgggcattggacgggtcaagggtcggcggtggatcactctgctgatcatgcttgccaacatgatgccccaggaggccctgctctacccgctttacatcatgttcaaaggcatgggcctctacaactcccagtgggccatcgtaatcatattcaccgtcatacagagcgctttcggtacctacctgctctcctcggtctatggcaccttccccaaggccatccttgaggccgccaccatcgacggtgccagcaggtggagggtgctcaaggacatcgtcttccccatatccacgcccacgctgagtgtcatgctggtcttcttcttcatctggacctggaacgagtacatgatccccatggccttcttgattgacaactccaagcagaccgtcccgattgccatcgcctccctgacaggagacaggcttatggatgtgacaaccacggctgcggcctcattgattagcatcgtacccacactaatcttctacctcgtcttccagcgcaccctctccaggggcattacgacaggagcagtgaaataaatgaaattcaccaatggatactggttgactcggcctggggtcgaggctctgtatgcccgttcgccttatgaactatcggtgggcgatgatggcaaaagcatagacgtgctggccactacgcaggtaattcatgatagggcgaatacactcaatcttccaatcttccgcattcatgcctcatcaccggcagagggcataattcgtgtccaagcctcgcactggaagggcagcagggtctgccccgggttcccaatcaatgagcaggattccgacgggggaagcgtaaccgccagcgcccagggccttggcgatggtgagatcggcgaggaaggtgccaccgtccgcctggacagcggtgacctgagcctgaccgtgaccaagggcgactccttcgatatgacctttaggtgcggtgaaagggagctgacccatgcccggggcaagtccctggccaggttccttcttgggcctgacgcggcggtgtccacccaaccggttggggagttcggcgtttcccccacggccagtgcctatgacgagtcgccggtcttcacctccatccagcttggcctgggtgtgggtgagcgggtctatggcttcggcgaacggtttggcccctatctgaagaacggtcagaccgtagacatctggaacgaggacggcggcaccgccagcgagcagggttataaggacatccccttctacatgaccagcaatgggtatggcgtcctggtcaacaacagggggcacgtctccttcgaggtggccactgagaacaccgagaccgtacagttcagtgtgcccggcgagaccatcgacttctacctgattgcagggcctcatcccaagcggattctggagaggtacaccgccctggtcggcagggccgccaaagttccagcctggtcatatggcctctggctgaccacctccttcaccaccaagtacgatgagcagacggtcacctccatgattgacggcatggccgggagggacataccgctcagcgtcttccactacgactgctactggatgcgtgagttccactggaccgacttccaatgggacaagcggttcttccccgatatcgagggaaccctgagccgcctccaccaggacaggggtctgcacgtctgcgcctggatcaatccctatatcggtcaggaaagcgcactcttcgatgaaggggccgccaagggctacctggtacgtaaacccaacggtaacatctggcagaccgacctatggcaggccggcatgggactggtggacttcaccaatccccaggcccgcgactggtacaaggagaagataaagaccctcctgaaccagggggtcgatgccatcaagactgatttcggtgagcgcatcccctcggatgtggtctggttcgatgggtctaatcctaccactatgcacaactggtacacccagctgtacaaccagacggttttcgatgccatcgaggaggcccgtggcaaggggcaggcctgcctgtacgccaggtcggcgaccgtcggtgggcagcagcaaccggtccattggggcggggactgtgagtccacttttaacggcatggcccagaccctccgagccggtctctcactggccagctccggtttcggcttctggagccacgatatcggcggtttcgagggtacccatcccgatccagcggtttacaagcgttggatagcattcgggctgctctcctcccactcccgtctgcacggctccaccgtctatcgggtgccttggctcttcgaccaggaggacgaacgccggggtgtggtcaatcctcctgagcagaccgccgtgagtgtgttgcgtgagttcacgaacatgaagatatcgctcatgccttacctctaccaggtaggactcggggcgcatgaggaaggcctgccggtcatgcggtctatgttcatagagtttcccgatgatctgaccgcccgggactgtgaccgacagtacatgttgggtccttctctgctggtagccccggtcttctcctactccggagacgtggactgctacctgcccaagggagtgtggaccaactggttcaccggcaagcaggaagactgccgccaggccggtcgttggatcagtgagcaggatggtttcgataccgtgccgttctgggttcgagacggaaccgtcctggtcacccgggagggtcaggccagcactgagtacgcctatggaaccgatgccacggtttccgttttcctggcccaggacggcaaggcccagacccgtgtccgggacgaggcaggcgacgatgttgtcttcttcgccgagcgcaatgggaatcaggtgactatcgcttcctcagacggtcgcgacttcaccggttgcctgggcaggggcgagggtgtgcgctcgcaggatgggcgagtggttctgactgtcgcataggcaggcatttgtgtgtcgctgcggtccatgtactgcggactgcagcgacacaccaggatggatgccagctcgaaatgcggcgtgacatatgagttgtcagaaaaaagcgattgttcaagatgacatgccagtagcccaatggaattagagcagctgactacggatcagcaggtcgcaggttcgaatcctgtctggcgcacgggaaggcaatggttccaaggttccacggcctcgggaccattcctgttttttcggaatcggacatatttcgggcacatcgtataagcaggtctatgggagctgaacgtgttgttttaggatttgggtatgtacttggttgtgcgtccgccgtaccctgccgttagggtgtctggcaggtgtgtcgaactcgttccggtcgatattgcggcgtatcaggtgcgccacatcctccggtgggtatctgagcagccgtccggtatgcacatacgggagttcgatttccagcgccctccaggcgttcaacgtgctcaccggtgtcagcagcctgcccggcgtcatggccgcgttcccattcgtcgtctctcgtgtttggctcatacctgtgggtcctgccccattgggggaatgtggccttgaaggacatcaccacggcgcgggttcagcgctggtatgtcagcctggcggatgggaaggcgccgtacggcggtgaagggggctgcggttccccgctgtccgcctcctcgtttgttcggcgggcaagatcgtgttgggctcggtcccggatgcggcggttgagagccgccggattggcgcgactccggtggcgcaggcgacggtcccaggaattgtccagatcgttcatgggacctctcaagccatccgatctgcgggtatggcattaggcaatacgccggttaccgactggacatgatctcctaagcctgctgccttcaacggttcttggctgctcaggaattcctacgggcgctggatgacgcgacccctcctgcgcttcccctttcatagcgttcacaaagagagcgctaccagtcatggttgcttccgggtgcgtgctagagaagaacactcgggcgactcgttatttgccgctcatcacgtcatggagttcttgcgcttgcttgtccttctgcgcaatgcccacgaaattcatcttgaaccgtaccgcgacccggttcattgtggcgtaggtggagttgatggtgttggtctgcacggcatccgcctccctggacaatcacatagaggtcgctgccttccaggtcgctgttgatctgcaggtgatcgatgaaggttttgagatagccggacatgttcgaccagtaaaccggagtgcccacgacgatgatatccgcccccttgagctggttccagatcgcgtcgaagtcgccgtcgccctgcccgacctgagggatgtggtgttcagacaggttaatctgcgtgtagggttgctttcccagcattcgttgagccaaggatgaggtattgccttgcgcgttctgactggcgttgatgaagacgatcttgctgccgctaacggagtgctgaggcttagcgaaatcctttctcccgcgaggagaagcgcccttggccgagccgctgcccaaggagacagaagccgcaggggctgctgaattctggcgcagggtgaaaccccaaaccgcgacagccccaatggccgctcgcagcaggaataccattccgcctgaaacactcgtttggttttgtcattcatggttcttcacgctccttgtcctggtcttgttgcagaacgccgtcgctgaaccccggtccaggggctcagcggtcctctaagtccgcgaaggtcattcctgcgacatgggcgaatcgggtaatgatgtgcgtgaccgggccgatggtgtcggaagggtcagcgccttgaaccaggactgagatttgcttgtctctcaaggcctcctcaaaatcggtagtttgggagatccgctcgatgagggttttcaaatatccgcttatgtcatgccagtagacgggcgtgcctagcacaatccaatccgcctgcttcagttggtcgaacaccgcggcgaattggtcggtgtggtcctcttgccccagttggctgatgcggtaatcgacgaggtcaatctgctgacagcgcttgcctttcaggacgcgctccccccatcttgctggtattgccggacttattgctgctcccgttgacgaatacgatattcatggcactcacgtcctttgcatagtgtgcgaacgtatagctccgacgctactgcttagagtgccctctaaggcaaatcgatttcttctgagcgcttagccttggttgcctgagaggatgctggacaacttttgtgaccgctgctcctggtataccgccaaggtgccatgttccaaagcttcgttgtaatagtggagcttcatctcgatggtctccagagctttggtgagtgctgcgattccatcctgcgtcttttgcttctggcgcacaaacatatcccgtcgctcctaggcagaggccatgccctcctggatcaaggtaaggtaatgtttgatttctttcagcggcatgcccgtttccttgaggcagcggacggtattgagggtcagtaagtcctcgggttcaaactggcggaccccatgagcgtcgcgccggacgaaggagagcaggccgattttttcgtaataccgcagggtatagctactgatgcccataaggtcgctgacctcttgaatgctcattgcgctcaccgccgactccccctcattgtcttgaccgttggcccgtcagtgactgtacaggcgttatggcgtcgattggatcatacccggagcctaggcaggacggctcgcggatggcatccagtgtaatcccgcgcggctacggcggtcttggcgaccagtgcgtcatcgtcggttccgctgagaatcaccattggcggcagcgggcgcctccgtggctgccaaaggcatataccgctcacgccgcctttcgcgtatatcctgaggattgaggggattcacatgtaatggttgggccacggaagccactggagcggacaaacggctccatatgcacggtatggacggccgcgaaagcgataccgtccataccacaaccggctctatcgtcggtgcaggtctacgctgtttgacagatcctgagtcccggcttagtcgccgctcgtcacagcgagatcgtcaccttgccgagcttgtcgatgagcttcatgttctcgctgtaatccacgggcacgaaaagcacgttgatgccctcgtcggccgccaacgtggacttgagggtatcaaccagctgctgacggctctcgatcagatgggcgttgccaccgaagctctccacgtactgctggaagtcggggttattgaaatcgacctcgctgtggtgacccagtcccagatccatcttccacttgatcaggccgtaggccttgtccacccagaccatggcggtcagcgggatttggtagcggtgggcggtttccagctcctgggagttcatcatgaaactgccgtcgcccatcatcgccaacacgtgcttattgggttcagccagcttcgctccgatggcaccgggcagcgtccatgacatggtagacagcccattgtcgatcaacagcgtgttaggcgcgtaggtcttgtacaggcgtgccatccacattttcaaggcgccggtgtcggtgagcacgatgccgtcgtcatcgaccgcctcgcgggtggctgaaacgatttgctgcggtgtcagggatgcgccggactccttagcgccgaaggccagttcctcctcgatggcgtcacggatggcggcggagaaggtcggtgcatggtaatcccccagctcttgctgcagcatctgcaggctggacgcgatatcggcgttaatgttgatcttcaccgggtaatgggcgtccgtgtccgcgctgaaagcgttgatgtggatgaccgggacctcgccgcgcgggttgatcttctcgggcttgaactccgagagttcgtatccgacggagacgatgacatcggcctggtcgaatgcgaagttctcgtaatcgtgggccatgaagcccaccaccccgagcgagtgtgagtcgtggtcgtcaacggcgcccttgcccatgtacgtagtggcgacgggcaggccggtagccgtcatgaaggcgttcatctcagcaatggcatgatcgcgcactacgcccatgcccgctaggacgatgggatgctgagcggatcgcaccatgtcggcggccgccttgatgtcctcctgcataggcaaactgaccgggtgcggcatggcgggcacgtgagtctggcctacggcctcagccgcctcgacgttttccggcatggccacgaaggtcgctccagggcgaccgttcatggcttcgttgtatgccttggcgattacttcaggcgctgattgggcctcgtaaatgttctccgaccacttcgtgactggggtgaacatggctcgcaggtcgattacttggtgcgactccttgtaaatgtgctccaggccgccctgggcagcgattgcgatcagaggcgtcgaattgctctgggcatcggccacgcccaggagcaggttgatcgcaccggggccaagcgtcgccgtggcgatgcctggctggccggtcagtcggccgtagacttcggccatgaaggaagcgccctgctcgtggcgcacgaggatgaactggatggacggggattcgtgaatcgcatccaccaggcgtatgttctcctcgccagggatgccgaacacgtatttgaccccgcgttcctcgagcacttacacgatttgctgtgcgactgtttgctgaaccatggtttcctcctacattgaatatctgactgagtgcgcgtcgtattacatgccgtattgaatgcctcgggccaatatgatgacgccaagggtgattacagagagcgcggtggtcaaggccagggtggacgccatctcctgctcgcttaacgagtggcaagcaggcaatcgtcgacttctgagggcgggtgccagcggctaccgtatccgatggcgtctgctccaagcagggtaaggccctggatttcattggcgcaccacaggtaagcgtgtcattgctgtccctatgcctggcggtcggcgcgggcaggccccttgcagcggcgggcgcatttcagcggtgccaagggtcgtatactgctcgcaaggcctttcgcatgcatcctgaacgcccaggagcctgtcctgtgctggcggacgaacgtgggcggcggattgttgcgttcatccgagtctgggcgtataccgaccagccgttcctggtaagtcagggcttcctgcagggtctgtcgggctgattcggtgtggttccggacattccggtccgcgaccctcggacagggcctggcggccttggagccagcggcttctcagacagacctcaggaagaccgcaagcacccctcagcacgcagtctgtcagcgagcggtccatgctggaggaagagcggttaattcacatgccgaaagatgaggccaccgcatgccgccggaccatgctgtaagggtagtcctcatgaggtggcctcctcgtattggttgacacaggttacgctcccgctcacctgtgcttgctgcttcccctgctctttccggtcacctgcttcttctcccgaatgtggaccgatagctgaatcggtgtgcctgcgaagccgaactcctcgcgcaggcggcgctccaggaatcgtctgtacgaagcttcaaggaatccagtggcaaagatgacgaagcgcggaggtcgcgttgccgcttgcgtggcgaacaggatgcgcggctgtttaccgccccggagggggtgcgggtgagcggcctgaaccgtgcccaggaaggcattgagctttccggtgggtatgcgctggtcccaggagtccagcgcggtgcgcatggccttagccaggcgattggcgtgccatccggtctttgctgacaggttgaccctctcggcccaggtgaccctgtcgaactcggtggcccacaagcgctccaagcgctgccgcccgaagtcatccagcaaatcccacttgttaaagaccagaaccacggcgcgtccggcgtccacggcctggctcatgactttcagatcctggtcagcgatcggctgggaggcgtcgaaaaggaccagtgccagctcggaacgctcaatcgccgcctgggtacgcaaggaagagtagtactcggcaccagaaatcttgtgaagacggcgcttgattccggcggtgtcaatgaaaagccagtcctgcccgtccacctgtacgacctcgtcaatcgggtcgcgagtagttcctgccagctcgttgaccacagcccgctcccgcccggccaactggttgagcagggaggacttgcctacattcggccgaccgaccagggccacccggcgcaggttggagggagtgaggaagccggaggtgcgttcggcctgcttgagctcggccacagcggcatccaaaagatcacccacgccccggccatgcatggcggagatggcgtaaggctcgcccatgccgagtttccagaactcagaggccgtgtagtcggcgtcggacgagtccagcttgttgaccgcgagcacgaccggctttccggccttgcgcagcatggttaccaggcgggagtccatgtcggtgagccctacctgcccgtccaccacgaagcagacggcatcagccaaggagacagccagctgggactgatcagcgattgccgaaccgatgccttgggcatcagcctcccagccgccggtgtcgacgatttggaagtccgtgccggcccactcagcctcgtaggtgaccctatcgcgggtcacgcccggcgtgtcctcaacgacagctgctcgacgccccaggatgcggttgaccaaggtggacttgcctacgttcggacgtccaacgacggccagcacaccgacggcccttggaccttgctcctcctcacggtctgagctctcggcttcgatgatagccttatcctcctcagccagctcgtagtcatccaggccctgccggtacgaggccgggtcttggtcgattgcggcttggacgatccttgacagcgcgtccagcgtctgctcgaaggtcatatcggagttgtccagttcagtgaccccgggggccggttcggtgaaggcagtgaccttggagtccttgcggtcgcgggcagccacatcgtccgcaccctcccctcccggggtttgggagaactggccgcttctcctggccgcacgcacactttcgcgtgcagtcagcaggactcgcacttcggcctctggcgccaccaccgtagtgatgtcccggccctcggcgacgactccgcggccctgggagtaagcgccctcatcctcttccccgcgcatgtaggcccgctgggccgcgatcaagacccgccgcaccgcacggatgccagagacgacggagacatgcgaggaaatccgagccgaacggatgcgttcgcccacatcctcgccatccaagcgaatccaagggtccgcgggatccatgctgattccgaagtgcccgtcggtgaacaaggcggccacagcctcgacaatggcctgcgcgtcaggttcgggggcgtccaaatccaagtcctgatccaggcaccacagggcggcggcgcggtacatggcgccggtatccaagtatgccaaaccgaagcgttctgccagggccttggatgtggaggatttgccgacacccgcaggtccgtcaatagcgaccgtaatcacagtccaacctccttgtccaaggccatgatttctgcccgggagaggacccggtaggaacccggcttgacgtcgcccaagcggatggggccgatctgagtgcgcaccaggcgcgagaccgggtaaccggccgcgtcgaaaatgcgcctgacgattcggttcttccctgagtgcaggatcactttgaccatcgtgtgatcgcgtgagcggtccactatcgcgcaatgatccagtttgatcagcccatcgttgaggagcacaccctgggtgacgagccggcggcagacgttgccgcccagcttgccgcgcacggtggccatgtaagtcttctccacctcgtacttggggtgcatgacatgctgagcgagctcgccgtcgtcggtcatcaggatcagaccctctgagtcatagtccaggcggcccatgtggaagacgcgttcatagcggtcaccgatgatgtcgcgcagggtgtagcggcctttggggtcgtccatagcggacaggaccttgcgtggcttgtttaaagccagggtgacatgcttgccggagatgtggatgcgcgaaccatccaccttgacctgctgcttgtcggggtccacgcggctgcccagctcggtgaccagagccccgtccacctcgacccggccttcggtgatgatttgctcgcatttgcggcgcgatccgaaaccggcttgggccaggaccttttgcaggcggaccccttcatcggaagcttcgtgcgccttcatggcgcggctgtatggatgtggcatcgttctcccaacgtggcctgataacatggcatagtgaatgacaaaaactcatcacagcttaccctaaagctgtgatttcagccgtcgccgcaaatagccccaaggaacctttgagcgaaagcaagggcttgccagcgacgggcgacacgcaacacgaaggatgcatgatggacccggatacggaaacgacggcagcgcaactcctgaagccaaccacactcgccgccttgcgagcggtggccgaattcaccggcagcttcctgatttgcttcgcggtgtacgcggtctgttcctgggggcggattcccgcaggaacctcggctcttgaggcggccacgacctgggcgctggcattcctggctgcggggtccattttcggcaaattctgcggcgcgcatttcaatcctgcggtcaccttcgccgctatgttcaccgcccaaatcggttggatacaggggttgtcatacatcctggcccaattcctgggcgccatcgccgccggcggtgtggttgtgtctctcctgccgctcaccacggagaatgacggcagggcctggctgaccgtggcggtcaacggcttcgataagggctccccctccgctgacatgcttggtaaattccacctgtccttcaacgtgacgctggcgatcgtcgccgaactgatcgccagtctgatcgtggtcgcagtggccatcaccagccttcgggatgacgggcggcccaagcgcgggcatgtctggcggtccgccatggcgtacggggtcgcggtcatgattacgtatccagtgaccggagccggtttgaatccagcccgttcgaccggcatcgcccttttcgcccatggcacaggcctggaggccgaccccatcagtcaattgccgatcttcatcgtctgccctctgatggcaggagcggtcgtcggtctggtcgtgattctgtgccacatggtcttggacggcgcccgggccaagctcgacacggcgcctgaaagctcgattgacatgccagcggccttggtgggtggagccgacgcgccgcaggaatccgttcacaccgaagcgggggacgagggcgctgacgcccacgataccaagacggacgagagccggagcgaagaccagaactcagctgccgagccagcgggtggggccatggccgctgaatccggcgacagctcacaggagcagcatgacgctcaagtaggtggcgaccagtcctaaacccaaaccgatgcagatgaaggcatcgaatgctactgagcgcaccttccaagggcttctacccctcagccgcagccgcataacccccaagcacagtgcagtcagggccatcagcagcgtaccaacgaaagtcctcccgcaagcagcgagaatcgccgaaagagcgacaagcaggccaaccgcccattcggcgatgggtttgccctccccagcttccgaaacgtgaggcttgtggggagcctcctgctccaggggttgtttgccttcttccatcgtcttgtcgttgtctgtcagccccgccgaatcatgcgaggaggtggcgtatggtctactggggtcacgcttgtgtcttgccactacgatcatccatcgtctccactctgtctgctgcagttgtcggaaccagcttagcgcatcggcgtctagtcccatccagcatcaggcgctcgttggcagggctggtgattcccgcagctaccgggctcaagacggccgccggaggcaagcaggctagcgtccagccgtaatccctactctcagccgatagcgcttagccggtctcttgtggaaaggctggtggttttacgggatgactcatgaccctttgaacgagaccggcacgtccagcgcatccctccacaatcatccacgccaacgacgggcacccttcgttgcctgcattccaggggcgtgcgctctcgctgcaaatccgtcggcgcgggtaagcttagggccgtgaacccggcgattcgcgcctgttggcttccttgggatggacagaagcatggttgctggtcgctaagcgcgaaacgctgcgccgtttgggttgaacatcagcggcgtcttcggccgattgcccggacttggccgcttggttcaattggacgctgcgttccacgcctcgcacaccgctgttccaagccaccgtcaaggcagccaccagcaggaagagcagccaggcgcacaagaagccgacggacaaaccccgcaccagggtcaatgtggcttcgggcaccgtcacacccacccaagctaggcggtgctggcctaatgaaccgctggagcacaggaaacccaggctgacagccccggtgcacagggcaagtgccactgccaggctcaggaagcaccgagcgaagctggcgaccagggtcccatccagcctctgcagcccttggcggcgaaaggccgctggaagccctaaaccccgacggctcatcaaaaaaaacatggcgagcaggaaggacatcagggcaggggtcaacaggagcaaagtcctcggtgtttggctgcttattggatctgggaaaagaccgaaaatcggtaaagaaggcagggcccgagcctgccccgaccaaggggtgaacacagccaaatcccctaccgagaaacctgagccgcaggcccaggagagagcccacatgatcaggttaggcagccatgcaagggcggcgaaactggtcacaatccgcgatccggtgcccatgcgcgacagcgagaacaggcggccaactgagtcatggtaaaggactatccaagaaatgacgagcgccaaggctccaatcagcagacagacaatcacccaaacggccaatctcagtccaatgctcagagtccgccgtgcagttgcgggcatatgattacgggtccaggatgccagccggtcccaggcatcgcctccttgtgcgaaagccagggcgtaggccaggaggtagaccgccccgctcttaagctccagggtcagcgtgtcatcgaccaggaccagcccccgtggcgcttgctggagggcggtcagcaggagccagacgacccctccgctgaagaaggcaggccatgagagaccgaaatgatgaatcaacgaactcgtgagagccaagagtacagcggtcagccctaatggcatgatggtcaaggtaagcacgccagccgtgaaaccacttccctggcttagcaacatgaccgcctgggtcaggggtatggtttgggcggataaggtggagccgccctcttccatcgagataaccaacagaatcaaggccgtgcaggagcctaccactgtcgcgtaaatggccagggctgccagggaggcgtacacccccctcaatccggctttcaggctttctttcattaatgccgtccgcacttacgcgggcatggaaaccagggtcgtgacggggtaatcctggagctcccgccgtccggcgagcccttctagctccatgatgaagctgaagccggccacctgacctcctgcccgcttgatcaggtcggccgccgccttggcggaaccaccagtcgcaatcaggtcatcgacgatcagaaccttctggcctgggactatggagcccttttccatctcaatcgtggcattgccgtattccagcgagtactcctgggaaagagttggtgggggcagtttgcccttcttgcgcagggctaggaatcccttgcccaagctcatggccagctgtgggcccagaaggaaaccgcgggcttccaatcctgccactaaatcgaaatcgctcgccgccacgggtaaagtcttcaccagggcctcggccagcaccttgagaccacgagggtcggcaagggccggcaggaagtctcggaagagaatgccctgcttggggaagtcaggaatggtcctcatcagggataccacatagagggcatcctcttggctaaccgcctggagttgcccgatactgatgtcgctcgactgagccatgatcttctttctgtcggtatcgtccgcgcagccgaagctgaccgcaggcgaaagcgtcttacgggcttggtttgagcggggcttcagcccttgtgctgggagacgccttcgctggcgtcatcgtcctgctcggaaggctgccgcgagccgtcctgggcctcttgcccggcgggagtggaccctgaatcaccattcacgacctgcttttcgtcgtcggacgaatcgtcctcgggcagggggtcgccgttctcatccacctcatcgtcgtgaacgtaagccggcacgatcggcggcttcgtgattgcttgaatccgccagcgggagagggagccttcggagtcgacgacgacttgctccttctccatatccactgacacgatcttgcccaacagaccagaagcggtggcgacctccacgccaggcttcaaggtctcgcggaaatcctgaatctgtccttggcgctgcttgttcttacgggaggaccaccaggtcatgccgaacatcaaggcgatcagcaggatcagaaacagcatggacgacatgtttgactgcacggttggctccttatgtgcgcgaatcaggaagggcgtcggccagcgccgcgaagcgccaggaatattattctaaaacagcttggtgacatcaggaaggcgtttcaatcccaagtgatcccacgccttgtcggtggccacacgacccttgggggttctgaccaggaaaccctctcggaccaggtagggctcacagaccgtctccaccgtctcggactcctccccaaccatagcggcgaggttgttgagcccgaccggaccaccgtcaaaggagcgcacgattgcgttcaaaacggctaaatccagccggtccaggccttcggagtcaatctgatagagagacaaggcctccttgacgtcgtcaggaccgatttgatccaagtcatggacgatcgcccagtccctgacccgcctcaggagacggttggcgatgcggggcgtgccccgggagcgtttggccagctgggcgctggcctgtccgttgacgttgatgcctaaaaccttggctgaacggcctatcagccgctccaactcctcggatgggtagaagtccaaatgggcggtgaaaccgaaccgcgccctcaggggtgagggcagcatcccctctcgggtcgtcgctcctatcaccgtgaagcgcggcagggtcaaggggatcgacgaggcgccaggtcctttccccaccatcacatccacacggaagtcctccatagcgatatacaagagttcctcagccgcgcgcggcaagcggtgaatctcgtcgatgaacaagacctccccggcctccagggagctgaggatcgaggccaggtccccggcatgctgaacggcagggccggaggtgatgcggatggggacgtcgagctcatgggccactatcatggccagggtcgtcttgcccaagccagggggtccggccagaaggatgtggtccggtgcgacctgccgcttttgggcggcggccaagaagaggcccagctgcgctttgagcctgggttggccgatgaaaccatccaggctctgcggcctcagttcctcatccgataccggctcgccctcaatcgggctggccgagaccatacgcagggactcctcctcgctgtcagagttcactatcacgccgtcagcccgcgaatcgtcaccagtcgcacgggtccgcgccttacctctgccgaccatcaacgccccctatccagaagggacaaggcggccttgagcaccaagggcacgtcggcgcggtccaggggcttttcatacccatttacctggcaggcctcctcaacggcgcgttcggcatcccgttggacccatcccagggagacaaggccttcgatcacctggcgcaggccttgatcctgggcctcggcttgcttgccggtgttcagggcatccacgtccatctttcctgaaagttccagtatgattttttgcgcgccctttttgcccaagcccggcgcccgggacagggcggccgcgtccccctgggagacggcttgggcgagttggtcgggcgtcaaggacgacaggagggatatggccaccctagggccgatgccgctgaccttgagcagctgggtgaaaagggtcttggacgagcgggacagaaaaccatagagggtgaccgcatcttgcgagatgttgagcgaggtgtacacagtcgcctgcgctccggtacgcagcgcagccagatccgaagacggcatacggacctcgtagccgaccccgccgacgtcaatcacggcgagcgattgctctatctgggccacggacccagtcaacatagccaacatgcctgccttggcctcctccgtcggccccgcagaggagaccagctcgaacgcatgttcgattcagcttacatgtccctttggacgggtccgcacctcttggaacgctgttgagcctgcgcccactgcctctgggcttgggtcaggtgctgctcgcgctctccgccttggagggcgccagccggtcgcagggcgtggcagatggcctgggctaaggcatcagctgcatcagccggtttaggtagtcgatccagtcgcaggatgcgcgccaccatgcgctccacctgaattttctcggcctggccgtttcctgtgacagccagcttaacctccgtcggcgtgtgcaaagcgaccggtatgcccctctgggccgcagcgagcatggccagcccggcagcctgggccgtgcctagtaccgtgtttcgattggactgggcgaaaacccgctcaatcgaaaccacatccgggctgtattcgtcaatcctggtcgccagcccattgtaaatcgccaggagccgaaggtcctgggagagctcgggatccgatctcaccacatccgtatggacgaacgagagacgacgggagactttcgcttctatgacgccgacaccgcagcgggtgaggccagggtcgacgccaaagacaatcaccgggccttattcctcatccaactgggccatgacctcgtccgaggcggtccaattgctgtagatgtcctgcacgtcgtcgaggtcgtccaggctgtcgatcagtttggagaccttacgggccgcatccacgtccaagctcacctcagtcttggggttgaggaccaggtcggctgaatcatagtcgattccagcatcctgcagggccttgcgcacagtgaccaggtcgccaggagcggtgattaccgtgtaggactcaccatcatcctgtacatcctcggctccggcctcagcgcctttctcgaagagatcatcgaagtcgaccccttcggccggcaccacgatctggcctttacgctcgaagttgaatgagaccgagccgttctgggccagtgagcccccgttcttggtcagcgtggagcgaacctcggccgcggcacgattgcggttgtcggtcaggcactcgatgatcagccccaccccggcgggcgcatagccttcgtagacgattgactcatagttggcggcgccggcttcctcaccggagccacgcttgactgcgcgagagatgttgtccgcgggaaccgacgacttcttcgcttttacgatcgcgtcgtaaagagtggggttcccatcaggatccccgccaccggtacgtgccgcgatctcgatgtttttgattagcttggcgaagagcttgccgcgcttggcgtcgatggcggccttcttatgcttggtggtcgcccacttggaatgccctgacatatcgctcctgacaaaatacagatgctttgaacttgcataattctaagcgttctctttgacaatgctagcgcgggtggacggtcgggagggtgcgctgcgcccagagctttccgcccgttcagcgccgcttagtcatcgacggggttggctgcatggctttggcgtacaccgtcaggatccgcgtggtcacctgctgccagtcgtaggtgcgggagcgctccaagcccgcctttgccaaagcctcgcggcgggttggatcggacagcaaggacgcgatgcgctgggcgcaggcccggccgtctccgttgtggaaatgcaaagcggagcaaccccgttgggagacggcttcaaatgcctctaaatccgaggccacgacaggacagcccgccgccatcgcctccgccaggacgatgccgaaggactcgccgcctgtctgaggggccacatagacatccaagctcttatagaacgaagccttctcctcgtccgagacccgccccaggaactccatgcgatcctcaaggccgggctgcacctgccgcgctatctggcgggcggagtcctggccgtcgccggcgcacaggaagcgggcgttcggctcgatctccaacaggctttgggccgcttgggcgaacactttaaagcccttgcgctcctcccccatcctgcccaggaagccgatcaccggtcgcttggcgctgcctcgccaggcgggcttcggccgggctgcggcgaagaaggatgccctgatgccgtttgggatgacctgtacctgggttgcggggttcaagtaacgcccggccgtgtcccgggctgcttcgctcacgcaaatggcctgcctgatgccgctcaaatacgagcgcaggtagggactggccaacttcaacgccagtgggtaggagtcgaaggaggcatggaaagtcgccacgtaagggcaggggtcgaaacctggggccaacggcttgtggctgaggctaggcacctccggttcgtgcaggtgaaggacgtcgaaacggccctgccgcacccactcgcgggtccggcgccccgccaagccgaagtagctgagattggcgaccgaaccgttataaggcaccgagaacgaggagccggtggtgtgcacccacgctggcatatcgggggtccgtcggccgggagccaggacctcaacctcgtgtcctagggctatgagctgctgggcgaagtctcggatgtgaagctgcacaccgccaggcgtttcaaaggagtaaggcgatatgatgcccaccctgagcttgcggccgcccagggggtcgggctcgcccactggcgtgtcgtcatgagcgcgcatggccccgcccaacagtccgatcgcccgcatggctgcgcatgggcgcgagcaagtcgtcaggaaccccgtgcaagcgggaaaggttcaagtcctctatgaaaatcggttgcatcatatgccaatcctgcgggtgggcgcggatatccagcgcccactggtcgacccaggcctggctgagggcctgcaccgcctgggcacgcggcatccgcaggtagggctctatcgcgattggcccatcaacctggcagacgtacccataggggctgtgtgctcggacccggctctcccctgacagacgctcccggtgcatattgaccgtgtacaagggcaggcgggaatccagggctatgaccgccggcccagctgccacacggataatcgaatcgaaggcatgaacgaagacgccattgcggctcaggtcgcggtccgcgagcagcggcaccacctgtccaggccgcttgaggcagtccgtcagccgctgggtcaatccgggctggcccgtcaagtaaatgtggatgcccaaacccctgcggatgccggcgaaggcttcaagcaggtcatggtcagtgagccgctcagccacagtcgtgaccggtcctacgtcttggccggcccagtagcccgcgtattcccagtttccctggtggcccatggctatgggcagggagctcacaggcatgtcctttaagcaactggggtagccggtcccctcgatgcgaatccgggccagcaattcctgggacgtgcgcgcaccgatggtcaaggcttcgcagaagtaggcgaaataagagcgcaaagcgcggcggctcaacttccgtaagcgctgggatgggagggggccggcgatgtgaccgaggttacgctccaactgggggacgccgcccaagcgtaggacccatgccacgtcggccactgcgttggccaggactcgcaggagaccttccggtagcatcttcgcgtgacgtgccaggaaaatgagcatgcgcgagatcatagcgactcactcgtgattggggtcggcgggtttgggggccaggctcatgtcgcctctgacctttccgatgcgctggcagacggtgatcaagccgagaacgtcgagcaggaggagggagcaggtcaggcaggccagaggcaggccggcgccggtcagggccatgcccaccaagatgatgaccaggcggtccgagcgggtggcgatgccgttcttggcctcgtagccctcggcttcggcccgggcgcgggcgtacgaagtgacgaacgaggtcatgatggcgaacagggcggcggccatgccgatctgggcccacaggtcagggcccggccgccgcgcggcgatccagtccagctcgtgcttgcgcatgctgatgatgattgcggccagcacggcccagtcggcgaccctgtccaatgtggaatccaggaaggcgccgaattgagtgccgccgccggtgatggaagctaccgagccgtcaagggaatcgaacgcgaccaggatggccagccctatggcccccggcagaagccatccggacagaccggtggcgaaagcgaccacgacggtgcctacggcccctatcaccgtcacgccattggcgctgatccccagacgcacaatcccccgggctatcggcgcgattgccctcttccaggggccgcgtaagtgctcaaacatccctctcctcaccctcaggccggtgaaaccgaacggcagggcccggcattgcctgcggcggaccctgcccttgcggactcaggccttgaccgcgtcggtgcgctccacaaagtcatcgaccgcactgatttgcgcacgccgagaaatggcctgtcgaatccatgcgatcgcgtcgtccaccggcacgccattgagctgactgccgtctcggaagcggaaggagaccgcgcctttggagacgtcctcctcgccggcgatcaggatgaagggtgcctttgactttgccgcattgcggatctttttgccgaaacgatcgtcggaacggtccagctcgcagcgaaccaaatgctccttgaggcggtccaccaccgtttgcaggtgggggatgcagtcatcggagactggaacggcctggacttgcacaggcgccagccaagctgggaaggcgccggcgtagtgctccaggaggattgcgaagaagcgctcaatggagccgaagagggcacggtgaatcatgaccggccgctggtgggaaccgtctgcggcgatgtactccagaccaaagcgctcaggcaggttgaagtccagctgaatcgtggagacctgccaggtcctgccgatcgcatcccgggcctggacggaaatcttcggtccgtagaaagcggcgccgccggggtcgtcccggagctccaggccggattccttgcccacttgggccagggtggaggtggcttcctcccagacttcgtcggagccaacgaacttatcgggatccttggtggaaagctccaggtagaagtcgttcaggccaaagtccttgagcaccttgagcacgaattccaggatgcttttgagctcccccctcatttgctcgcgtgtgcagtagatgtgggaatcgtcctgggtcaagccacggacccgcgtcagtccgtggacctctccggacttctcatagcggtagaccgtgccgaattcgaacaggcgcaggggcagctccttgtaggagcgctggcgggacttgaaaatcaggttatgcatggggcagttcatgggcttcaggtagtagtcgaagccctgcttgacgaccttgccgtcgccgtcccgctcctcgtccaggtgcatgggtgggtacatgccgtccttgtaccactgcaagtgtccggaaatctcgtagagatgacccttggtgatatgcggtgtctgcacgaaggagtagccgttcttcctgtgcatctcgcgcgagtagtcctccatagcgttgatcaccgcggcgcccttggggtggaagaccggcaggcctgggccaatctcgtcagggaaggagaagaggtccatctcagatcccagcttgcggtggtcgcgctttgcggcctcctccagacggcccatgtaggctttgaggtcctccttggaagcccaggccgtgccgtaaatgcgctggagcatggggttcttctcgtcgccgcgccagtaggcggcagcggtgcgcatcagcttcaaggctttgatatagcgggtattgggcagatgggggccccggcacaagtccttccagaccacagctccttcgtggtccaggttgtcgtacatgctcagctcgccgtcgcacacctcgctggcctcgtcgccctgaatctgggcttcggtcaatccgatcagctcctgcttgtagggctgaccggcctcctcggcccgggcctcatcctccgagacaacccgccgacggaaggattgcgaggacttgatgatcctcttcatccgccgctctatctctttcaggtcatcgggggtgaaaggctgttcgacatcgaagtcatagtagaagccgtctttgatgaccggtccgatgcccaacttggcgtcgggccttacctcttgcacggcttgtgccatcacgtgcgccgcggaatggcgcatgatcgccagcccctggtcgctgcctagggtaataggctcgacagcatcgccatcgttgaaagtagtggccaagtcacgcggttggccattgaccatgaccgcgatgatgtccttgtcgtccgcgaagagctgggtaccggtggtgccggtcgccacctccttcgcgtgatcgctcagattgatggagatgttcgactggttcattcagtgccgtcctcgctatcggggcccgcggtacagggtgcaggcctggacttatattacggaagcaacaataggccctcgcgccgacaaggccgccttcagaccccttggtcctggccgccaaccgacttaaggaactcctcggcttcgcgtaccagctcctgggccgtgggctcgtccacctggtcgggaatggaagcggcgacccttgagtcgctctccacttcgaggcggcgcacatactcggccaagtcgtcgttgcagcgggtaagcaccgaagcctgggcccgccatcgctgggctttcttgggtaaatcgccctcatcaaggttgatgccgagcatccccgaaacccttcgcaggagctgaagggtgccctgggcgcattcgtcggaacccaggtattgggggacggagacccaaatggattctgtcgcgaagccggactcactggccagggcgtccaggactgtaggcaccccaaccggtcctgagtgcccctctgtgtcaacgtccgcctcgtcactggctaggtcgtccatgggcagttcccgggtgtgggggcagtcagcgaacatggatcctaatgtgatgatccctccgacgtcgtaatcctcggccatgcgtatgctgcgccggcagaattccgcccagcggtagttcggctcgggacctgtctccaccagaagggaggtgtcgtcggccagcctgacctcgtaaaacttggtttcgggccaacaaatcgagcgcctgccctgcacatggcagagcatggggcgggccacttggtagtcatagaaatcctcgcagccaatcgtgcccacctcacgggactcgtaggtgttgagcagatggcgaatcacgttggtcgatgcggaacaggcatcgttccatccgtcgaaagcggccaggaggtaagggtactggcgcggcttggcttcttcactcataccttccaccctaacctgcctgcggagggctccgggtcagtatgccatcagcgagaacgaatcgagtccgtgaatcaagggctggcaaggccacgctattcgactcaagcgtgtcgtcgcatattttagagaaagtaaaagaagaaagaagaccaaatgctctggtgggtgatgcaggaatcgaacctgcgaccccttccgtgtgaaggaagtgcgctagccgctgcgccaatcacccgatacttgacccagcctgcgcgactggacatacggactggccaaatcagccagccgagtgggcgatacaagattcgaacttgtgaccccttccgtgtcagggaagtgcgctacctctgcgccaaccgcccgggtcttgtctctttcgagagaggtgggtacgagagtcgaactcgtctatacggctttgcaggccgctgcctaaccgcttggctaacccaccgtatgaggggtgcaactactcgaagcctcgagcgggcaacgggactcggacccgcggtctcgaccttggcaaggtcgcgctttaccaactaagctatgcccgcgtctcaatgtgttccttgtggggaccacctgagcacgaggcactactgtaccggctcggggccgaatatgcaaggacagcgtgtcgccttggaatacgtgggctgtccttccgtagggactaacagccgtccttctggcggtcgggccccgtcgtgagggtggcgggagagtcctgcccatggtcgtctgcacatgcatcccctcccccaccagcacggctctgcgtcgagcggcgcgcctgggagcggggacggggatgcaaccgaggcgtatcgcgtagggccgaagcgaaaatccggggatcgttggataattgcgaacgcttcaggcatgcgcaaacgcatgcggcacgagttgacgaaagggttgcggcgaataggtgagtcaggaaaacaaggctggtacgaaggtggggccggttacggccgcggtgttcatgtccactttcatgactgcagttgagggcaccattgtctcgaccgccatgcccacgattgtgtccgatctgcacggactgagcctgatgaattgggtgttctcaatctacatgctcatgtgcgcggtgaccacccctatatatggcaagctctccgatcgcttcggacgacggccccttatcaccacaggcctcctggtcttcgtcgtcggttcgctcctatgcggcctatcgcgatcgatgctccagctgattgccgcgcgcgtggttcagggcttgggcgccggtgccatccagccgctgaccttcacgatcctggctgacatcttcccgatcgagaagcgggccaagatgattgggttcaactcctcagcctggggtgtggcttccatcgtggcgccgctcctgggcggtttcctggtccaacagctttcctggcactgggtcttcgcggtgaacgtgccgattggtctgatcgcggcgatcctgattcaggtcttcctcaaggaggaagttcaatcccgtaagagccccatcgattactggggcatagctttgctcactttatgcttggtcggcctcatgctgggcttgcagaatttgggaggctcggtcagtgccttggccagcgtccttcccttggtcctggctgtgatcgctggtgtcatcctgattgtggttgagcgtcggcaggctgatccaatcctgcccttgaagcttttcagcaaccgcaccttcgtaatccagaacgtggtggtcctgctgatttcaggcttcctgatgggctttgagacctacctgccgattcgcatgcaatcgattctaggcttcaatcccactatcgccggcttcgcgttgaccccctcctccatcctgtggctgctgggatcgttcatggctggcaagctcctgatccgccacccgccgcactggataaccagcctgtcgctgggcttcctcatcgtgggctgcgtggcttcgatcctcgtgcccatcaataccgcttacgccgtcttcctggccatctccgcggtcttcggctacggcttcggcctggctatcacaatcagtacgatgacctcgcaatcggtggtttcagccgatgaggtgggtacggcaacctctttcaacaccctggcgcgcagcctggggcaaaccttgatgatctccctgttcggcatcgtgatgaatgtggtcatggcccaaggcgtatcgcgcacccctgggctgaccgccgacatgatggaccggatgctcaacccgcagaccgccggacaactgcccgccgagtacctccaaccagctcgggcgatcgtctacgacggcctgcgctggattttcatcgtcggcctgatcaccctgctggctggcttggtcatcaacctgttcgaccgtaagtccaaccgtttgctcatgcagaccaaagtcagcgaggcgtaagcggctgaaggccttgctcctgcgccacgacagcgccaaacgatacacctaccgttccttgcgcccagcgctgtgtttttccgctgcgctcttccccgcgaagccatcctgggctgattcccgcttacgctgcccccgagcgggagccaagggctttcctccaccttgggggcccgcggagccctccgctcgcttggatgcctgcgagcgaggcaagtcatcctcccgccggtactggtgaatgcagtaagcaaggccagccaaggtgaccatgataatcagcgctacgcccaagggcctttggtcgtagcgcttggccataggcacgatcaaggcgtccgccaacagggcgacccacaggacgacgatgccttctgacttgtgcgacatagttctcctcgcttctgcgcggttcgacgccccaccagcaagcgggcggaatcggggttgacgcccgccagggcccatgatagttttaagctggtatgggcagttcaggcgatagcgcctgccgtcacctcggagccgagcgattccgcgacgcttttcgcgtgactacctgtaaccatatcccttccccacggttgggggcgctataagcatcgccaagacacctcatatgcaaggacacgcgcatgaaacattttgaaagggactcactcacgcaagccaggcatcagcagcaagccgtggccgagaaccgagcaaattgggacgatcgtgccatcgtccacgccggaggcgggtacggcgacctggacgccctggcccaggatgccaacgccatcaccccagtcgtccatagggacctggccgtgcttgaaccccatctgccccaaggaggcgtgtcagggctcagcctacttcacctgcaatgccacatcggcaccgacaccttgagctggcggcggttgggggccagagacgtgcacggactggatttctcgcccgcctcgctggagcaggcccggcggctggctgagcgagccggcgaatcaatcacatacgtggaggcggacgcccgctatgctgaccaagccctgcccaataaacggttcgacctgattgtgaccagcgtgggcaccgtcacctggctgcccgaactgggcgactgggccaggtcaatcgcccacctgttgaagccgggcgggatattcatgatccgtgacgcgcaccccttgctgctcgcactggacgagcaggagctgcgcatcaccagcgattacctatccggcagcgaggacgcctaccagagcgacggctcctatacgcctggctctgccggacgtatagcgcacacgagcaaccacaactggtcgcacgatttccaggagatgaccggagtcttgctggccgctgggctgactatcgaggcgctgggtgaatatccgggttgcgagtggcaggccatgcccagcctggagtggaaggaggacgaggggctctggcggcttccggagggctcgccccgaatcccgctcagcttctcgatcgtggccaggaaacctcgcctcagccagacagcgggagccgccgacgggtcttgatggcatgacgaagaccccgaaccgattcgaacgacggtccgggggccttccctggataacgcggtgaacgcaggcccttaatcaggcggctgcggcgcctcccacggcggggatgactcccgtgagcaggaggatcgcaacgaggactgcgaggcagatccggtagatgacgaagccccggtaggagaacatggagacgatcttcaggaaagcgatgatgaccaggtagccgatcacgaatgagacgatggtggcgcagatggtggccccccaaccggggaaggccgcatccgcgtgaatatccttaaccgacttgaaggtctccagaatgccggcgccgaatacggcggggatggccatcaggaaggagacgcgggccgcggcctctcgcgtgtagcccagggcgcgaccgaaggtcatggtgccgccggagcgggagacgccgggaatcagggccagcatctggccgatgccgaacaaaagggcatccctggcggtcatctgctccatcgtcttgctttgcttgccgtgccggtcgtagtagtccagcaggaggccgaaaagaatcagcacgatgaccgtgatccacaaattgcgcagcttggtctctatcgtcttttggaagagcaggccggcgatcacgatcgggattgtgccgatgatgatgttccagcccatagcggcgtcctggtccttggagccaaggcgctcacgccaggaagggccgtccttgccccgtaggcagttgtaccagtggcggaggatgcgggcgatgtcgtgccggaagtagagcaggacggcgaactcagtgccgaattggatgatggccgtgaaggcggcgcctgggtcctgacccatcaaagcgccgaggatgcggatatgggcgctcgatgagaccgggaagtattcagtcaatgcctggactaggccgaacaatatagcttggaaaaagttcatggacccctcacctgataacggaagcggacgcgaccccgaaggactagcttaccggcccgcctgcccaagctccagccctagttgggatgtcgcgcagaatgcccacaatggtgtacaggacagcagtctaaaggaggcgttcatggctcagacctataggaagacgcgcggcggggctccaacgggattcttcgagtgcgaaggcaagggcctccagtggcttggccaggcccaggatcatggtggtccacgcgtggtcaaggtgttcggctggggccgggactatttggacatcgagcgcgtggagagcgccgcccccaatccggaggccgcttaccggttcggagcccggttggccaacttgcaccaggccggcgcccagtggttcggatcggcgcccgacggctacgagggcacttgctactttggccccctccaagacccagtgccgatggacagcgggcaatggactgatccggccacttacttggcggaggggcggctcaggcccatggtccgtatgggcatcgagcgcggcgccctgaacgagtcggacatggaactgactgaacgcgtcatcgacgccctcccccgcctcctggcagccgccgccgacgacaagccggctcgggtgcacggcgacctatggagcggcaacgtcatgtggaccgctgaccgtgggcgtagcgaagcggtgctcatcgaccccgcggcccacggcggccaccgggaggaggacctggccatgcttcacctgttcggcatgccctacctgagccaaatcgaggatggttaccgctccgtccacccgctggctgcgggcttcagggaacgctacaccctctggcagctctatccgatcgccggccactgcgtcttcttcggcggcggttacgtcagcgagtaccgatccatgtgccgatccttgctggagtgagccgctctggagctcaagcccgcggttcaagttggggcccggaccctgcacctgagcagggtccgggccccaacttcattcacgccgctaatgccgcgacccctgcaggcagccttaactgaacatgtccttgagcttgctgaacagccccttcctccctccgcccaagatgggcttggaggactgggaaagctcctgctcccctgagtcgtggctgtcggcgaaacgctcgatgagttcggactcgcgctcgttgagcttgtcggggatgaccaccagaacgtggacgaggatgtcgccgcgctcctgggaccccatcttggtgacgcctaagcctttcacagtgattgtttcgccgggctggcagccggcgggcacctcgacctcgcgggggccgtcgaaggtctccaggcctgccgtgtggcccaggaccgcccaggtcatcggcacgctaatccagcagtgcaggtcgtcgccatcgcgggtgtagagcttatcaggcctgatgttcacgtcgatgtaaagatccccggcggcgccgccgccttcgcccacttcgccttgggatcccagacgcaaacgggaaccgtcctggatgccagcgggtatggtcactcctacgtcacggcggacccggacgcgcccgtggccctggcactgcgggcaggggtgctcgatgatcgtgccgtgtccctcgcagcgctcgcagggggcggtcgtcatcatctgaccgagaagggtgcgggccaccttctgcacgtatccgcgccctttgcactcggggcaggtgaccggctggctgccgtcctcagctcctgagccggagcaggtctggcagaggccgaaagtgtgaatctgagcatgggccatgccgccgaaaaccgcggttttcaagtcgatcgagacctcggcgagggcatcgcggccaggttgggcgcgcggaatcgggccctgggaggaactgtcgaaaccggagccgaagaactgtccgaagaggccacccatatcgaatccggccgcgcccgcctgggcgttggggtcactcgggtcgacgccagcgtcatacatcctgcgcttgtccgggtcggaaagaacctcgtaggcggagttgacttctttgaacttgtcttcgaattcagggccggcgatgtcggggtgatatttgcggctcatcttgcggtaagcctttttgatctccgcatcgctcgcctcacggctcacgcccaatacctcgtagtagtctgccaacgatcgttccttctgtccttggatgtccttgccattgtgccattagggtcggtcagggcccgatgctcagacctggcccatgcggcgtccacaagccggtccacgccgcgttttcaccgccctcagccgtcttcaccctcaccggaggtcaggaatgaggtcaaataggcggccaccgcgcgcaccgcgctcatcgtgaccgtataatccatgtgcgtggggccaatcgaaccgacgaaagcgattgggccatcgccctgcccgtttgtcccttcatgccattggtcggttcctgttgcgtgcccgtagccactggtcacgatcgatgcgtgcagcaaacccggcgtgcgggtctccgaccctattgccaccgatacgccgccgtgggtgcgggagagctcgctctgagcgctcatcagcctcatcagaaccacctgctcctccaaggcgtccaggagcggcgcaagttcggcgacggtcaaggtttggcgtcgcgtcaactgggagcgaccggccatgtagagccctgaggactcctcctcgtccgccatgccttccaggacttgggccaggccttccaggagccgcctgctccccgcctcgtgcacctgctcggactgggtctccaaccgttcggatgccttggacaaggtcatgccgcggcactccttattcaaggactcggagaacttagccaacaggtcctctccgaggtcctgatcctggtgcaggctcagcgtgtgctgggcgacgcgcccgttgtcggtgatcaccaccacgagcagggcgcggccggagatgccgatcagctcgagccgacgcagccgtgatttagcaagggagggcgaagcgaccacggctacctgtccggtgatctgcgccaagagccgggcggcccgttgaagcgcgtcgtccaagctgaccgagccggacaggaaggtgtcgatggccttgcgctgggccccgctcaacggcaccatcctggccaaacggtccacgaagtagcggtaacccttctgcgtcggcacacgaccggccgaggtgtggggctgcaccaggtaaccttcatcctccaaggcggccatgtcattgcggaccgtagcggagctgacaccgagcttatggtcacgagcgacggcgccggagccgaccggttcctgggagcggatgtagtcctcgaccacagcccgcaacaccagcatccgcctgttcgccgccatgtctcctcctcacccatcccgattactcgtgtcaggccagggcaccgggaatgatgctcgattcccattgtattagcactcgcgacccttgactgccaaggccttcgtccagagctgagaacgcttgcatctagcggaaggaagaaggtcttgggtgtcggctcaggaggatacgataagagagaaatgccacggtaaacgaacattttcggcacaagtcggaacatgtcggcctaccaattggaaggaaagttgatcagatatgaccgatttcacatggactgatctcgacaagcgcgccgtcgacatggccaaggccctgtcagccgatgccgtggagaaggctggatcgggccaccccggctcccccatctccttggcgccgatcgcctacgcgatctaccagcgcttcatgatccacgaccccaacgaccccgagtgggccggtcgtgaccgattcatcctctctggaggccacgcctcgctgacccagtacgttcagctcttcttctccggctacgggctgactctggacgatttgaagaagttccgcactgcaggtacccgaacccccggtcaccctgagtacggcctgacaccaggcatcgaaatgaccactggtcccctgggccaaggcctggcttccgccgtaggttttgcatacggccagcgcttcgagcgcggcctgctggaccccgaggcgccttccgggcagtccccattcgaccacaaggtctgggtcatctgcggcgagggcgacctggaggagggcgtctcctccgaggcttcctccttggcgggcgatcagaagctgggcaacctgactgtcatcttcgacgccaaccacatccagattgagggcgataccaagatctccctgggcgaggatgtgcttaaacgctacgaagcctacggctggtacaccgatgagttctccttcgtgcagcccgacggctcctacaaggaggatgtcgagggcttcgcggccgtgctggagaaggccgagcaggtgaccgaccgacccaagttcatcaaggtcgacactctgatggcctggcccacccccagcaagaccaacgatccgtcagcccacggatccgccttgggcgcagaagccgtcgcaggcctcaagcatgccctggggtatgacccggacgagtccttccacatcgacgaagaggccctggcccacgcccgcgaggtcgcccagcgcggcctggccgcccataaggaatgggacgagcgtttcgaggcttggcgtaaggccaaccccgacaaggcttccctctacgatcgcatccactccggtaagctgcccgaggacttcgatcaggccattgatcaagccgaagcagcctttgagaccggctccaagctggccacccgtaaggcttccggcgctgtcctgaacgcgatcgccaaggtcatgcccgagctctggggcgggtccgccgacctgggtggctccaacaacaccaacatcgacggcgccgcgtccttcgaccctgccgacatgtccaccaagcagtggcctgaggccaacccctacggtcgccagctccacttcggcgtgcgcgagttcgccatgggcgccatcaccaatggcatcctgctgggttcggacacccgccccttcaatggcaccttcttccagttctccgactacgagcgcccggctgtgcgcttggctgccctgatggacatccccaacctgtacgtctggacccacgactccgtggcgctcggcgaggatggccccacccaccagccaatcgagcaccttgccgccatgcgcgccatcccccagatggaggttgtgcgcccggccgatgccttcgagaccgctgaagcctaccgcgccttcttcgaaaaggacaacacgcaccccacggccatgatcctgacccggcagagcgtccccacgctcgctgagacccaggccaaggccgcccagggcgtgcgcaagggcgcttacgtgctaatcgactgcgatggacagcccgacgtgctgctcatggcatccggttccgaggttcagcacgcggccgccgccgccaagaccctggccggcgagggcgtcagggcacgcgtcatctccgtgccctccctggattggttcgaggagcaggacgaggagtacaaggaagcgatcctgcccgcatcggtcaaggcccgcgtctcggttgaagccggactggccatgccctggtacaagtacctcggctcctatggcaagcccgtctcgatcgagcagttcggcctgcaaggctccggcgacgagaacatgcgcgacctgggcatcacgcccgagcacgtggttgaagccgccctggcgtccatcgaagcggtcaagtccgcccactgatccagcgaaggcccaacaaatacaccgttcccccgccgtcctaatcggcggggacctaaaaggagaaacacaacaatggtagaaaatgcaaacacccaacgtacctccgactctggagtctcgatttggctggacgatctgagccgcactcgcatcgagtccggcaaccttcagcagctgatcgctgagaagaacgtcgttggcgtcaccaccaacccctccatcttccagaaggctctccaccaggtcggcccttacgacgcacagctcaaggagatgggccgcgtcaacgtggaagaggccgtgcaggagctgaccactaccgacgtgcgcaacgcgaccgacatcttccacgatgtcgccgagaagtcggactatgtggacggccgcgtctcgattgaggtggacccccgtctggcccacaacaccgaggagaccgaaaagcaggccgaaatcctgtggaagaaggttaaccgccccaacgcgatgattaagatcccggcgacgctggaaggcctgccggccatcaccgccaccctggccaagggcatctcggtcaacgtcacgctgattttctccctggagcgttacgagcaggtcattgaggccttcatcgagggcatggtgcaagctgaccagaatggccacgacctcaagcacatgggctcggtcgcctccttcttcgtctcccgcgttgacaccgcggtcgacaagctcctggaagctaacggctccgatgaagccaaggccctggaaggcaaggccgctgtcgccaacgcccgcctggcctacgagctcttcgagcgtaaattcgccgccgacccccgctgggccgccttggaggccaagggcgccaagaagcagcgtccgctctgggcttccaccggcaccaagaacgccgcctactccgactgcaagtacgtggacgagctggtcgccccgcacgtggtcaacaccatgccggagaagacactggacgcgttggccgaccacggcaatggcgcgccttcaatcgaaggcacctatgaggagagccacaaggtcatggatcagctatccaacctcggcatctcgatcaaggatgtgaccgataagctggaggctgatggcgtcgctgccttcatcgattcctggtcctcggtcctgaccgatgtgcaggcgggtatcgaccgtgtcaacggttgagggctgagtgctgtgatggggctgtcgcggataatgcgctgacagctcgaccctcctaatcactgaggccactggcggatcattgcgccagcggcctcagctttattcccaaaccgacagaggatcaaaccttgaacagcccttctacggattcacatgaccgtgccgcgaatcaggatcgccgctaaagctgaattcattggtttgcaatgagcggtcgaaatcgcgaatccatcgggtgtggcgacgcaggccgaaagcgcctgcctggtcagagcctccacacggctgcaggaggtgcccacctgggatgtgacaacccgcagcgggtgcgaaagcaacccggattcgtcttcgtcatccgtgctcgcctaggaacggcttgttcatggatgggagtggcattcaggcgtgacaggagtaagtcgctggaccaatgccaggcttctgccacgatcgtttgcggaccgatatggaaacgcccctccgtccatcaaggacaaaggggcgtgataagtatgaatcagccaatgtggtatttagccatcaagcctaaggcgatgatgatggccacccaaattagggccacgatgatggtcaggcggttcaagttcttctcggccactcctgaggtgcctgcattggagctgatgccgccgccgaacatgtcggacaggccgccgcccttacctttgtgcatcaggataagcagagtcagcaagatgctggcgatgacgacgattactttcagggcgatcttgacaatggtcacaggttacctccacatgtgtgctaataatagtctagcgcaagggctggagagccccgaaccaaaccgtttcccggctcaacgctggcgagtggccttcagggtcatccgggcgattcgagcgaactcatccacgtccaaagccgcgccaccgatgaggaagccgtccacatccggctggcctatcagttcctggacgttcttggacgtgaccgaccccccgtagaggatccgcatggcctgcgctggctgggagccgaaggcggactccacatgcgagcgtatcgccctcgccgcctcccgggccacgtccggggtggcgaccatgccggtgccaacggcccagaccggctcataggccacgatcaacttggcgacatcgtccttggacaggtcgcgcgtcacatcttggacttggccgacagcgaactcgagttcgatgccctggcggcgctcctcgtagctctcgcccacgcacaggattggttgcatgcccgctgccaggacggccctcacctggtcgacgatgttcgcatcatcctcggggtggtacttgcgccgctcagagtggccgacaatcacataggagcagccaagctgcgctaacatgtcggcggagacatcgccggtgaaggcaccctgcgaggtgacggatacggtctgagcgccgtagtgaatcttcaaatcgtcggcctcgaccaggacttggaccgaacgcaaggcggtgaatgcgggcatcagagccagttcgcagcgccggtagtcgaacttcgcgtccctgagcagccaagccagcttctgaaggaagtaggttgcctccaagtgatcgaaattcatcttccagttgccggccaccagcggtatgcgcgccatgacgccctctctcatgattcaggggactgaatgcggtgagtgccgggcgacgctcaccgccacccggcactcaccggaacaaggagtccctatagactactccaggaccttgagacccggaagctccttgccctccaggaactccagggaggcgcctccgccagtggagatgtgggagaagccgtcctcggggaagccaaggttgcgcacggccgacgctgagtcgccgccgccgacgatagtgaaggctcctgccttggtggcatcaatcatgccctgggccacggcccgggttccctcggcgaattgagggacctcaaagacgcccatggggccgttccagacgacggtcttggaatcgacgatcttgtcgtggaagagcttgcaggaatcagggccgatgtccaggcccatcatgtcggaaggaatcgcgtcagccggaacgacctgggggtcgatcgccgcatcgccggcggggaaggacttgttgaccacgatgtcggtggggaagaccagctccacgccacggctcttggccgtttcgatgtatcccttgaccttgtcgacctggtcctcctccagcagggaggagccaacctcgtagccctgagccttaaggaaggtgaagaccatgccgccgccgataaccagacggtcggccttgttgagcaggttctcgatcacaccgagcttgtcggagaccttggaaccacccagcacgaccgtgtaaggccgctccgggttctcggtgcccttggacagggcttccacttccttttggaccagcaggccggcagcggagggcaggtcagccgccacatcgtagtcggagccctgggccctgtggaccacgccgaagccgtcggagacgaagacatcgcccaaggcggcgatcttcttggcataggcggcgcgctcggcgtcgtccttgctggtttcctccgggttgaaacgcacgttctccaaaaggatgacatcgccgtcgttcatggcagtgaccttggcctgggcgtcctcgccataggtgtcctttgccagagggacctcaatgcccaggagttcacccaggcgcttggccacaggagcaagggagagctcagggacgaccttgcccttgggccggcccaagtgggccataacgatgaccttggcgccttggtccttcagatttttgattgtaggcaaggcggcgcggatacgaccgtcgtcagtgatcgtcgtgccgttcagaggtacgttgaaatcagcgcggaccaggacgcgcttgcctttaagattaccgaggtcttgcagggtcttcatggatttcctttcctggccgccatcacgccgcgcactcctcggcgccgtaaacggcctatgctgtcacaatgtgactccacttgctcatgatagtgcagcgaacggataagcgttagggactgccccgaccagcgttcaagcctgctcttcgcgctgtttgcgtactttttgggccagctggagcaagcggcgaattcgcccggcgatcgcatcctttgtgactggaggatcggccaaacggcccaattcctcgaggctggcgtcccggtggtccagacgcagctgaccggcggcgcgcaggttttcagggatatcgtcgcctaggatcttgaaggcttcagtgactttggcggaagcctccaccgcggccttcgccgaccgacgcatattcgcgtcgtcgaagttggccaagcggttggccttgcctctggattcgccatccgagcgtttgccggtccattcgcgggccgccttgggagcgccgatgagaatgagcatccgctcaatcgcgtcagggtcgcgcaaggtgacgcgctcagaggagcggacctggcgagccttggccttgatccccaagcgtcgggcgacctggaccagggccagggcagcttcggaacccgggcagacaatctccaggtatgaggctttacctgggtccgaaagctctccgtgagccatgaaggcgccgcgccaggccgctttgatttgggagatgttgcccaagacgatgtcctcgggcaagccgcgcaccggacgcttgcgccggtccaggaggccggtttgaagagccagggcgccgccggccttgaggacccgcaccgagtaccgcagagcctggcctgagggggtctgccgagcgacttcaatcaggtccgaatcatgaccgtacacgtctttgatcatgttctggagccagcgggcggcgggcagggagtcgaattgcgcctcaacaacgatatggcgttggatgatatgcaagccaccggcgaaacgaatcatcgctgcggactgggctttcttggcttggggtagctcgttgtctatgctagcgagctcgcttttgacgtcatccagtagggccaagacccgtcctcctacgattctatgcgattgttctgggcccgcccgaaccggaacgaacgaggccacaggactactgtgataccgaatatcttggacaagtaccactgatgtccaaggcccggggcctgtcccgaagcaagcccaagggtacccgcggtacgggaccataagcaagaattaaggccggaatcggcctaaagcttgttcttacgaggtaactccctggcggagaccgtcacgtccaggccctgggagcgcaggcgggcagctagctcttcgctgatcgccaccgaccgatgctggccgcctgtgcagcctatcgcgatgttgacgaaatgcttgtcctccctggcataaccgcgaatcgcggtcatgatcgccttggtataggcgtccaggaagtccttagccccctggctgtccatcacatagtcgcgcaccggccggtcgtgtccggtaagctcgcgcagctccggcacccagaaggggttgggcaggaaacgcacatcggccacgaagtccgcgtcgatcggaatgccgtatttaaagccgaaactgaagatgtgaacggcaaccgtagcggggccctggccgagcaaggaatcgtagagcttagtggagagctggtggatggtcaggctggaggtatcgatcacgacatctgcccgctccttaagcccctccatcaaccgacgctccttacgcaccccatcgatcaggcggccgttgccctggagcgggtgggggcggcggaccgactcgtagcgcttgatcaggacctggtaggaggcgtcaaggaagaggatgcggcacctgacccctaagtcgtccaagtgccccagcaccgcgttcagatcgtcgaagtatgaacgggaacgcacgtcaatgaccgctgccaggcggtggaccttgctgcccgccgaggtcatcagatcgaccatggggaccaatagcttgggtggcaggttatcaaccacgtaccaacccatatcctccaggctgtcggcggcccgggaccgacctgcaccagacatgccggtgatgagcatgacttcgaagtcctccaagggcggccgcgctgagtcatcctgggaacgcccgcccgcggactgtctgacctcgttcatcccatgaccccttccttggtcccgccagcgctcctgacgacgcgagtcggcggacagggcgtggccgacgcggcggctcgggcgacccgcgacgcggcgtcccttccacgatcaaggctacccctaccccgcctgggcaccaagccctggaccgtgggtgacctccccatgctctggtttctcagcgggcgaggaaacacctgcttccgcgctcccagcggattcttggtctgtgtggagggcctggtaaatggtctcggccttcttgcgcccgattcccttgaccccctccagctcctccaccgtggcttgccgcatccgccggaccgaaccaaaagccttgagcaggcgcttttggtaggcctccccaacgcctgggatgtcatccagggctgagcgcaaggaaccttttcgccgggtctgccggtggtaggtgatagcgaaacggtgagattcgtcacgaacccgctggagcaggtacatgccctgggactgtcgcttgaggatgatggggtagtcatcgtcagccacccagacctcctccagacgcttggctaagccgcacagggccacgtcgtccacgccgcagtcggccaaggcgcgagccgccgcctgcacctgaggcttaccgccgtcgacgacgatcaggttgggcttgtaagcgaagtgacgaggttgggcgttctgctggacgacttcagcggacgcgaccgtgtctttcctgtccggagccgtttgccggccttgggccgcctgctcggcctggcgctcattctcaatggtctcaccagtgtcgccggctatgttgccgtgcctgaagcgtcgtgtcaaggtctcgtagatagcgctggtatcgtccaaggcccccttgccgtcatcgccacggatggcgaacctgcggtattcggacttcttcgccacggcgtcctcgaagaccaccatcgacgccacctggaaggcgccaccaaccgtgttcgagatgtcgtagcattcgattctcaaaggggcctgcttgagtccaagagccttggcgacgtcgttcatggccgccgtccggtcgcccagatcggaaatgcgactcatcttggaacgctggagggattgctgggcgttggccccggcccggtccatcagggcttttttctcgccccggcttgccacacgaatggtcacggccccaccgcgaaggttggaaagccaggactccaggtcgtcgacccgggcgggtttgaccggcacgaccacttccctggggacaggcgcgataggctccagcaggtcggcccggccggtgatctcctgccgttcatgccttgccttagtggccttagcccgatctgccaccgctagagccgtcacgcgttgggtggagcccaaggcatcgcggctctgactgacctcaatcgaattgtcttcgccctcgggcaggaccaggacgggcagggaggggtcttcctcctgccggtgctcggaaaccaggtcggagtatacctggatgatcaaatcgctcatcagctccccgtcgctgacatcctccacccgctccacggaccacgatcgttcgccgcggatggcgccagcgcgcacgaagaaagcatggaccgaggcttcaagttcatccgaggctatgccgaacacatcggcatccacatcggagttgaagaccacggaattctgctcgatcacagtgtccagcatggcgatttggtcgcggatccgggcggctttctcgaagtcgagctcatcgctggcctgggtcatccgtcgtttgagcccggccttgtaggatttgcccagacgcccggtcatcacgcccacgagttcagccaccagcgcgcgatggtcctcggggctgatccgccccacgcatggggctgagcacttgcctatcgatgccaggaggcaaggcctgccggtcatctgggcccggcggaagacacccgacgagcaggtgcgcaccgggtaggtcttcaataaggcatccaaggtgtgccgcacgtcccagactttggcataggggccgaagtagcgggtgtccctccgcttgcgtatccgcgtcatccagacccgtggcacctcctcgcccacggatacggccaggtaggggtaggtcttatcgtcgcggaagaccacgttgaaccggggatcgaactccttgatccacgtgtactcaagcgtcagtgattccagctcagtgcccacaacggtccactccaggctcctcgccgtcaggaccatggtttgggtgcgagggtgaaggttgaccaggggttggaagtagttgctcagtctgttgcgcaggttcttggccttgcccacgtagatgacccggccgtcgccgtcgcgccacttgtaaacgccgggctgggcggggatgtcacccgccttggggcggaagaggtccctgctgtcgcccagcaagggcgcgccgttcttgttgaggccttctcgcgcagggtcggagccggtcagcgatgattccatcaaggtctgggcggtcttacgccaaacccctggcgcatggcgttcaaaacagcttctggacattcaggccttcgctttaccttttgcgttccgcgcggacccgccggccctgcctttgacggctgccctggctgcgttggccgtgtgtttcttggctttggcctgccgctcggccttagccaccttggctgggtccagcatgggtttcaggaaccttcccgtccagctggccgggttggctgccacttgctctggggtgccttctgccacaacccgtccgccaccgtcgccaccctcaggaccaaggtcgatgatccagtcggcggtcttgatcacatcgaggttgtgctcgatcacgatgaccgtattacccttgtcaaccagaccctgcagcacgcccaagagcttacggacgtcctcgaagtgcaggcctgtggtcggttcgtccaggatgtatatggtgcggccgtccgagcgcttctggagttcagtggccagcttgaccctctgggactcgccgcccgagagggtgggcgccggctgccccaggcggatgtagcctaggccaacgtcgaccagggtcctcagatagcgcgaaatggaggggtaggctgcgaagaagtcggcggcttcctcaatgggcatgtcgaggacgtccgagacggtcttgcccttgtaggtgacctccagtgtctccctgttgtatcgcttgccatggcaggtctcgcactgcacatacacatcggggaggaagttcatctcgatttttatggtgccgtcgccgtggcaggcctcgcagcgcccgcctttgacgttgaaggagaatcggccaggcccgtagccgcgcacctgggcctcgggcgtctcggcgaagagctgacgaatcttatcccagacccccgtataggtggctggattggagcgaggggtgcggccgattgggttctgatccacgtggatgaccttgcgcagatggtccacgccctccacccgcgtatgcttgcctggcacgatgcgggcgttattgagcttgtcggccaagaccgggtagaggattgagttgaccaaagtggacttgcccgaaccggagactcccgtcaccagggtcatgacgccgagcgggaacctgacggtgaggtccttcaaattgttctcccgggcgcctacgacggtcaggcgcttggtacggtcaatcttcctccggcgagggggaagctcgatcttacggcggccggcgatatagtcgccggtgatcgagcgcctggcctgggtcagaccgttggacggccctgagtagatgacctctcccccgtgctcgccagcccccgggccgatgtccaccaaccagtccgcttcccggatcgtgtcctcgtcgtgctcaaccacaatcaaggtgttgcccagatcgcgcaggtgcttgagggtggcgatcagacgctcgttatccctctggtgaagaccgattgaaggctcgtcgagcacgtacatcacgcccaccaggcctgaacctatttgcgtggccaggcggatgcgctgggcctcgcctccggagagggtggcggccgcgcgcgacagggtcagatagttgagccccacatcgttcaggaagcgcaggcgggctcgaatctccttcaggacttcaccggcgatcttagcctgggccccgtccatgtgcagcccctcaacccactcgcaggattgggagatgggcatgtcgcacacctgggctatcgagagcccatcgacagtgaccgccaagacctcgggcttgagccgcttgcccaggcaaaccgggcaaggcacctcccgcatgtaggattcgtagtactgtttcatcgaatcggagtccgtctcatcgcgacgacgcatcagggttcgcaccacgccctcgaagccggtcgtgtactcgcgcaagcgcccccagcggttgcggtaggagaccttcaccttgaagtcgcgcccgtacaggaccgcctgccgcacatcctccggaaggtccttccaagcggtggatgtggaaaagcccatctcctcagccaggccgtcaagcatgtgaccatagaagcgctgttgggtcttggtgctcgaccaaggttccacggccccgtccttcaaggacttatcggggtccggcaccaccagatcggggtcaatctccagtttgaacccgaggcccgtgcaggccgggcaggctccgtagggtgcgttgaatgagaaggtgcggggctcgatctcatccagctccagctcatgcccgttggggcaagaccggttctcggagaagggctgtcgccggtccttgtctttggggtccaaatccacgaaatcgacgacgatacgacccttggcgagtttcaaggcggtctccaccgagtcggtcagacgctgacggaccgaactcttgaccaccaggcggtccacgaccacctcaatcgtgtgcttcttctgcttggccagcttgatgtcgtccgagagctggtgcacttggccgtcgatgatggctcgggcgtagccgtcagagcgtaaaaggcccagggtctcgacgaactcgcccttgcgcccacgtgcgatgggcgcaagaatctggaagcgggtcccctccggcttggccatcagcgcgtccacgatctgctggggcgtctgggcgcgaacctctgccccgcagactgggcagtggggtatgccagtgcgggcgaagagcagacggaagtaatcgtagacttcggtaatcgtgcccacggtcgagcgtgggttacgattggtggtcttctggtcaatggagacggcggggctcagtccttcgatgaagtccacgtccggcttgtccatctgccccaggaattgacgggcgtatgacgacagggactccacatagcgccgctgcccctcggcgaagagcgtgtcgaaagccagggaggacttgccggaaccggacaaaccggtgaaaaccaccatcttgttgcgaggaatggtcaagttgacgttcttcagattgtgggcccgggccccttgcacgacgatcttgcggtcgttgggcaaatccgtgaggtccgcgatcaggctgccgtccccggggatcatcctcggtcctccggctgcttgggattggccctcggtcacgttcggctgctgcacttgcttcatcccgttccttcaatccgactgctccagagattacatcgtaccgcatctgctccgatatttcgaacaagcgttcgattatagcgaaggggtggccggcgggcgcttggctgcctccggacggcaaggggccagcccccgctaggatggtatgagggaagtagtgcaggggctgaggggcagccccggtggaaggagcagacatgggtacgtatggtccatcggagcaaaaagaagcatccacgacgcccaaggcggggtcggggcagggcgttcgcgctcaagagtccaggaccccatccgccctggaatccgaacgccaggccgagggctcggtcgctcgggccgacgacgcgcacgccaagcaccgtaggctgatcgagagcatcgtcctatgggccgcctggttgatcatggttgccttcaacggctatgccgagattttccacctcaacggcgtcaacgtcggacaggtcgcccacgaaggcaacgtctggttcatgcccgctggctgggccttcgccatctgggggctcatctacatagtccttgccctctggctgattcgtttttgcttggcaggcccatcccgaaaagccctgggccccctgcccttcagcttgtctggcctgctgttcgtagccacttgcgccctcaacatcgcctggttggcctgctggcatttccgggccttcacggccagcctcctgatcatcgtggtcctgaccgccctgacatgggtcctctacggaatcgtccgccgggatcagcatgaggaagacacggccaaggcggcccgcatcttggactggacgcccctgtccttgtacgcctcctggttgacgatagccacgctgctgaacgcctgctacacagtgcaggtgctctccggaggagtatcggatatcatacaaatcttcactgtagtcattctgctggtgctcctcctcatcgccgtcttcctgatgcagcagaaggcgggtgactgggtttgcggcctggtgctcctatggtcgggactggccatcggcatcaacatcctttcgcgcagcgtggccgtgggcgttctggtcatcgccctgaccgctctgggcgaagcgctggcctacttcccttggagcaccttcaagcttgttcgccgctgagcacaaggtcatatcagccccttcgctatgatggtcggcggggattgggaccgcgttgcctagctgggacgcgcggaccgacccgcacatccacttcagagaaagcgtcgggcaaggcatggctatagaggcacagggacttgagattcgcataggagcccgcctcctgctcgaagccaccgacttccacgtgtccaaaggggaccgcatcggcctggtggggcgcaacggcgccggtaagaccacgctgacccgggtgattaccggcgatatgctgccatcggcagggtccgtgcgggtgagcgggcagctgggctacctgccgcaggacacgcacgctggcgacccagagcagaccgccctggaccgggtcatgtccgcccgcgagatcgcctcgatcatcaagcgtttgcgcaaggccgaggccgagatgaccagccccgatctcaaggtcatggagaaggccatgcggcgctacgacaaagcccagcaagattttgacgcagccgggggctacgcagcccagtcggaggccatcgtgatgggtgagagcctggggctgagccaggacaccttgcatcagagactggggacgctctccggcggtcagcggcgccgggtggagctggcccgcatcctcttctccggtgccgacacgctgatcctggacgaacccaccaaccacttggacgccgattcgatcgaatggctcaaggactacctgaggaaattcgatggcggcttcctggtcatctcccactccaccgagctcctggacgagaccgtcaacaaagtctggcacttggacgcccagcgctcccgcatcgacatgtattcgatgagctggaaagcttacctgaagcagcgggtggttgacgaagagcgccggcggcgggagcgcgaggtggccgaaaagaaggccgaccgcctgatgaaacaaggcatccgcctgcacgccaaggcgaccaaggccgtggccgcccagaacatgatgcgccgggccgagcgcctcttggaaggcacccaggaggccgagcggggcgagaaagtggctgacctgcgcttccccgagcccgcgccctgcgggcgaacgccgatcatggccaaagagatctccaaggcctacggttccaatatcgtcttcgccggcatcaacctggccatcgacaagggctcacgcgtggtcatcctgggttacaacggcgccggcaagaccacgaccctgcgcatcctcgccggcatcgagacgccggataccggagaggtcgaactggggcacggggccaagatcggctacttcgcccaggagcacgacaccctggaagaggatctgagcgttctggagaacctccagcacgtggccccggacctggacgacacccaagccaggaccatcctaggctccttcctcttttccggcgacgacgcgatgaagccggcttcggtgctctccggcggcgaaaagacccgcctggccctggccaccctggtgacatcgcgggccaacgtcctcctcctggacgagcccaccaacaacttggacccagcctcacgcgaggagattctcaaggccatcgccaagtatgagggcgctatcgtcctggtgacccatgacgagggggccgtccaggccctgaacccggagcgggtcctgctgatgcccgacggggatgaggacctgtggaacgacagctacctggacctcgtggccgaagaataggcggcggtttaccccagcgccccgcctgtcgcgcaaggcctgatcggcgacagggaacataaccagcgtcgggaggaagccggtgtggcggcggccgcaatcggaagcgccaccatgccgtcccgcaggaggcccccacggtcgaatcatccgtgagcgcaggccagacggcgcatctgggccgaaggatacggcgtcggagcttcacaagcctagcccggagccgcgtaggccgtgatgcgcaaagggccccaggacggtgcgaccactcaatcaacccagcacagggagggcacggtcacagccaaggcgactcgctaggcgaccaccggtatctcattgtccctttccacggagctcgcggcatgatgacgactgacacgggccagcgcgtgccgcgggccagcaagccggatagagtggtggtaggggtggaatgagccgccctggaagtcatcagcaaggggaaggacgcacggatgtcgaacgaggagagctgggtgttggacaaactgacgacgacggcctatcagtcaagcacggtgcgctccctggagcgacccctgctggacgatggcgtgccgctgatgaggatggccgcgaaagccgtcgctcttaatgcacgactgctgctggccatgtccggcatggagctggaccaggcccgggtcgtcctcctggcaggcggaggggacaacggcggcgacggactttacgcgggcgccctgcttgcttcagcaggttcagacgtgaccgccgtggccacgagtaacgacctgcacgatcaggggctgacggctttccttcaagccggtggggttgtcctcgccctgagccaggattccgacatccccggctcggacgcccctgcgtccgcggatgaggcggcggaaagactggagcaggcggtaagtctggctcggagcgccgacctggtgatcgacgccatgaccggtatcggcctgaatggggccctgcacggggtggctgacgccctggcctgcgagcttgggcaggcggacggcggcctggccccagacgtcggcatcccccaggacggcaaaagcaaacggccgctggtcctggcggtggacttgccttcaggcataggcgtggacgatgggagcctgcctggctcctatataccagctgatgtgacggtaacattcggcgctttgaaaccctgctgcctcctgcctcccgccgcgtacacctgcggcaggacggtcttggtcgacttcggcttcgacctggactcgatccgccccgacgttgaggccatgacggctcaaggcgccgccgacgtgatacgcgccccccgcatcgacgacagcaagtacacgcgcggggtggtcggcctggtcactggttcggagcgctaccctggcgccgcgatcctttcgacccgcgctgcggccgcggctggcgcgggcatggtgcgctatatgggccctagcagacccactgacgcggtgctagcggccttgcccgaagcggtgagcggccctggccgggtccaatccctggtcctgggctcaggcgtgcccaccgagcaagcagccaacgacgaggaaccccaacgcgagaccatcggaggcatcctgcggacccgtttcgcggccagaccatcagatgaggactccgagggcgataccgagattccggctgtggccgacgcgggcgccctggacctcctgcctggggggaagacgccccctaccctggtgctcaccccccactttggcgagctggccaagcttctcaactcttgcggcgagagtctcagcgcctcggacatcgccgccgaacccctgaattgggccatcaaagcctgggagttgaccggagctacggtcctgttgaaaggggccgtcagcataatagtcggcgaggatcaggaggggcggatgcgggtcatgaccaccggcttcggccccgtctggctctccaccgcgggttcaggggatgtcttagccggcgttcttggcgcgacgctggccggcgccgctgaccgcttggaggaggagccctggcagaccgtcccaatcgcggcttccggcgctttcctgcacggcttggcgggctcgctggcttccggtgggcttcagcgcggttggcggcagccccttgtctacgaccccgagaacccatccgacttcctggaaagggcccaggatggctggaaggctgagtccaagggggctggaccctggagtcccctgggccaccccatccacgccaccgatatcgtgtcgcatctggaggaggcgcaaggcctcctgctggccctgccgtacacgagccagggggaggacgacgcggacgatgacgcagatgcccctgacgggatacccgcggatggcccggcggactgggcactgttgcaagctggctgggcagggcctgcggaattcggccaggccgcctcggctggcattgattcgttgtggttctagggaatttctagggaaaagccttagaggaaggtaaaaggaggaaacatgcgtgggcgcttgattatcatgcggcacgggcagagcgagtggaccctgccccaggtgaaccggttcgccggctgggtggacgttcctctgagcgagcaggggcgacggcaggcggaacgagcaggccagctgatcaaggagtatggtctggagccggaggtggttttcacttccctcctcggtcgctcgatcatcacagccaacctgctattggaccaaatcgaccggctctggataccggtccagcgcacctggcggctcaacgagcgccactatggcgccttccaagggcagacccgtcctgacatgctgtccaagtacggcgaaaagcgtttcgccacctaccgccgctcctacgatgtggcgcctccagcccttgacccctcatcgccttactggcagggccaggaccctcgctacggcaaaccgtgggccgacggtctggatgacttggacccggcgtcgattgcctcggagtccctgaaggatctaggccagcggctggagccttactggcgtgcgcgaatcgtgcccttgctggcccagggcaggacggtgctggtcgtcacccacggctccgtcgtacggtcggtcgtcaaggggctggaagcggtctccgaccaggacatccgctccatcaacgtacccaccggagtgccgatggtttatgaattcgagacggatcagagcagggaaccggagccagtcgggtctggccgctacctggacccggatgcggctcgaaagggcatggcgcaggtagaagcgctgggcaaggcttgatccggaggatcgcagacggcgcaggcaggccctcccccgccgttatactgggcccatgaccctcctccagctcaagtacatcatcaaaatcgtcgagtgcggttcgatgaacgaagcctcccacgagctcttcatctcccagcctgccctctcttcctcggtcaaagagctggagggcgagctgggcgtcgaaatcttcacccgccactcccagggaatcgcgctgaccgtggacggcgccgaattcctgacctacgcccgccaggtcctggaccaggtgggcctcttggagcaacggtaccagcagacaaagcctcgcaagcaactgtgccgtgtttccacccagcattacatgttcgcggtcgaagcgttcgtggagatgatcaattcgattgaggccgatgagtacgagttcaccatcagggagacccgtacccgggatatcatcgaccaggtggcctccttgcgttcggagatcggcatcatctaccagtccggcttcaataagcgggtcatcaccaagctcctgagggagaagcacctggtcttccacccgctcttccgctgcaggccccacgtcttcatttcgcgccggaacccgctggcgggccgctcccgactgaccatggagaacttggagccataccccttcctccaatacgagcagggcgacgaaggatccttctatttcgccgaggagccggtttggcccgactattccccccagcaaataacggtgtcggaccgcgcgaccatgctcaacttcatcgtcgggctcaacgcttacacggtgtgcaccggcatcgacaacgaggacctgaacaccgagaagatcacgaccatcccgctggaatcggatgagaccatgctcctggggtggatcaacaacgagcgaaccaaaccacccgaagcggcacaactctatttggacaagctgggcgaggtcatcacccaccacggtttcgaattgattggttgaaggcgggggggggaaagccgtcagccgcgaggaaacgaatcacatctgatgcggtcggcccgtaccaccaatcgaaggcaaggaaccggctcggcccacttggttctcatccaaacccagggcctggcacaaggccttgcgggcttcgtcatcacctggcttgatatggctgatttgcatgaagacgccattgatgatcaccgtgggtgtggaaagcctgcctttgctttcgccctcagggttctccagttcatgtcgggtgatcgtgtagtcattgagctggtggacccattcgcggtattcgccgctggcggccttacgggcgacagcctcaggcacgcctacgctcattatccgcttggcgatctggtcgtcgctcacgtcggcgccgccctgctcgctgggttggaagtcttgcttgtagaaggaggccaccacgtccaagaaacgctccgggtcctcctgggccacgctcgcggcggcggaagcggccctggtggagtactggtcggagcgttgctggtccaggaagtccaggaagtggatgcccaggttaatctggcccgccttgaccatagcgatcagcgtggggtccaaggagcggtggaggcggccgcagggcgggcagaggaagtccatgtagatgtcaacggtcgggaccgcgctgatgggcttgcccacgccctccttgctgaccaggatgccccctaggtcgtcggctttggagggtttgaccctgactgcggctagggcctggtaagcgtcgttcttggtcggggcgccggtggtcgtagcggcgggctcggctccgcccccgtgaccggaccggtgaacgacgaacgcgccgaccgcgaccagggccgccaggaccaggacagccgccagtacagtcaagagccgccgatgagatgagctcacgctccctccgtcgtccccgctttcactgcgatcaggttgtttgtcgacgttgggctcttgtaccatcgtaggtcctgtctccttgcgtcatgagctcctgattccctgccatgatgatacctgagcaccttggcaagtcgctcgcggttcccgccccagcttgaatcagaccccgtaacgctccaggtaggcctgggcacgctcgtagagtcgctcattcatcacaggccttccttgttcatcctgcatgccccgggcggcttggaagacctggcccacgttagcaatcgaaaggacggggaagcccagctcatccatgaccgcttcgacggccgagcgccccgagtcgtcggccacctccatcctgtcgacgctgatgaccaggcccaccacctgcacgttcgcggcggccttgagcttgggaacgcactcgcgcaccgcagtgccggcggtcatcacatcgtccaccagcagcacccgcatcccgtcttcgagcggggcgccgacgaaggagccgccgtccccgtggtccttcttctccttgcggtcgaaggtgtacccgaccgtgcggccgtgcgccgaactcagggcgatggcggtcgaaacggccaggggtatccccttgtaggccgggccgaagattgtgccgaagtcgccgggaagctggccatcgcgcacgcctttaaggatgcgacgggcgtagaactcgcctaggagcgcaatcttggcgccatcgttgaaagctcccgcattgatgaaatacggcgagcgccgaccggacttcagcgtgaagtcgccgaaacgcagggccccgctgctcaacaggaaacgggtaaaggcctgggacagcccctcttccccctcgtcgcccttgcttgcctgtccgttcacgcttacttccatgatgatcccttctctaaggtttcggccagctcgggtcgctggtcgagcagttcgtccaattgccgcgctatgcgcaccggcgccacaggatccaccagggcggccgcacccacctcgaccgcgttggcccccgcgtagaggaattcgagcgcgtccgagccgctggcgatgccgcccatgccgatgatgggcatctcgggcagggcctggcgcaccttccatacgcaggccaatgcgatcggcaggattgcggggcctgaaacccctccggtgacgttgtcgatgatgggccggcccgtggtcgtgtccagtctcataccaaccagggtgttgattaggctcaaggcgtccgctcccccattcgcggcggcgcgcgcgaccgcggcgatgtccgtcacattcggcgtgagtttgaccaccatcggtttgtcggtcatggccctgagccggctgatgagacgttccagaccgactggatcggtgccggccgacatgcctccgtgcgtgacgttagggcaggagacgttgatctccagcatgtcggccggcgagtcggccagtttagccaccacttgcgcgtagtcgtcgtcgctgtgcccggccacgttggtcaccaccaaggctcccaggtccttcaacctgggcagttcgtcgaccaggtagtcgtccaccccgggattctgcaagcccaccgcgttaaccatgccagatggcgactctgcggtacgcggggtgggattaccctcccaggctacaggcgagacgcccttcgtggatatggctcccagctggctgacatcgtagaagtcttggcaggcatcgagcttgaaggtgccggaagccgcgccgaccgggttcttccagacgaccccagccacctgtgtgggatgacggtaagtgtatggctccagggggtcgaatccatccatgctcatgcgttcgtccatcctaactgctctccggtgaagaccggtccgtccgcgcagaccttgagtctgccgtccactgtgtccacagcacaggccacacaagctccgtacccgcagcccatccgctcctccaaactgaactgtgcggggatcgaacgggcagccgcccaggccgccaccgctttcatcatcgctgtcggcccgcaggagatgatcgcggatctggctgggtcgagctggggctcgaaacggtccaagagcgtgatgacatcgccctccggctcactgatcgacagggttcggtcagcgctggctgccaccagagggtccgcgaatcgctcattctggtagccgaagacggctatggcccgagcgtcagcccgctggctcagcgcttgggcagccgcgatcagcggaggaacgcccaaaccgccaccgaccagcaagtagtcgcctggtcggctcaggtcgtacggcctgccaagaggccccagcaggtcaacttcatcgcccggcttcaggcgggcgagcgcggcggtcccccgaccgattacctgatagaccaagtccagctcgtcgccgtcagtcctcgcgacgccgaaggggcggggcagcatggccgagggatcgggagcatagagattgacgaattggcccgccgaagcggtcctggccgcgtaagggtcgcggacggtcaatagccgggccgcgccgccctccaggctgagcgccgcgctgaccttagcggtgcgcctgcctgggcgtttgccttccgcctgggcttgggcgaccacctgttcggtaggtctgaactgagtcgtttgaatactcacttggtctccttcacggcttgggtcagttctgttttcatcgtcacagcggccttccgagcctcggaggagaccagtcccaaggccacctccaggctgagcgaggggctccaggatccgctgcgtttccaggcgcctatgatgccccgggaggagttgactatcgcgccggacccgtccggcccgaacatggccgctgcatcctttgccgttccgccttgggccccatagcccggcaacaggaagaaggtgtgcggcatagcttggcgcaagagcgctcccacctgtggctgagttgcgcccacgaccgcaccgatacgggaatagccgcaggaaccgacgctggaggccccccactcctccactagctcgccgacccgctggcacaggttgcgcccctcttgcccatccgcgagggggagttcctggatttggctggaggatgggttcgaggtgcgcactaaaacgaagatgtccttgtcgtgggcctgcgcagcctgcacgaaaggttcgatgccgtcggaacccaggtaggggttgacggtgatcgcgtcctcctgccagggagagggggcgggggcctcccgatgggccgggtccgtccctgcctccacttggagacaggcctggccccaagtcaggggaagaccggacaggtggcaggcgtaggcggacgcagttgatccgatgtcgcctcgcttcacatcgccgatcacgtagagcccccgttcccgagcggcccggcaggtggacaggtaagcctcgatgccgggagcccctagggcctcgtacatggcgatctggggtttgacggctggcaccaggtcggccaccgcgtccaggaccgacagattgaaacgtacgtaggcctgggccagttcataggcccaggattcgtcaaggcgcctgcgatcgtcgggctccaggtcgtcaacgccggcgggggtcaagtcagggattcccgacttggcgcgggtggtttccacggcctggcgtatgagctggtcgggcaggagggcgggccgtgggtccaagcccactaagctggggttgccttccttaccggctatggctgcggctaagcggtccatgattgccttccttccgggttcttcctcggggcctgggcaacgactgccttgaacgccttcgggttgatgactgagtgcgtcggtcgccctccgacgatcgtcatgagcggcctgccgctcaccgtcatcccctcgaagggggtgttgcgggctttggacaggaaacggttggcctctaccgtccacgactcttccggggccaggacgactagatccgcctgggctgcctgggcatcggccgtgaggtcaagcacaggcgctgaggccccctcctggctcctctggccgttaaccttgtgcatgatggctccgatgtcggtggatgccatgcccattaatcgcgcgggggccaggctcatcagctcgatgagcctggcctcgtcgatccaccctccgtccaccaaaacgctgtggcagaccccgtaagcgctctccagacctatgaccccgttgggcgctgactccaggccccgctctttctccgccctggtatggggggcgtggtcggtggcgatcatgtcgacggtcccgtcggccatcgcctccaggctggcctgcctgtccgcctcggagcgcaagggagggttcatttttcccatggctcccaggcgtggcacgtcctcgtcggacagggccaggtagtggggcgcggtctcgcagctgaccggtaacccttgccgtttggcttcgcgtatggcctggaaggcgccagcggtggacacgtgctggaggtggatgcgcgcgccagtggtccgggccagcttgatgtcccggttgacgatggcgagctcggtggaggccggaaccccctccagacccagtctgcgcgagaccggcccctggttgatgaatcccgtgcggtggcgctcgcagtggtccaggaggggaatgcccgcggcccgcgcggagagggcgacctgctcggcgatgccatcagtcacggcggcaccgtcgtcgctcagggccactaccgggtgcagggccgcgttcggatcgctctgggacacgggaccgcccggcagatagtcggcccaagcggagggcgggttcggcaccaacccctctcggtcccgcgaggccgccgcgcacaaacggtagcctacgggcaggcggcggccacgctccgactcgtacccctggaggtaaccgatgacctcgggcccgtccatagccggctgggtgttgggcatgatcaggaccgaactataaccgccggccgcggccgccgagcagccagtgatcatatcctccttgtcggtgccgccgggatcgcggaagtggacatgggggtcgaccagccccggggccaagagagccccggtcagatcgaccgcaagggtccggccctgcgcgcgctcgcccagcctccgccaagcttggacctcgtccgcacctgcggcgaaacgctccacatcaggccaaggcaggaggaggtccaagccttggccggtatcccaggctttgaggccgcgaagcagcaggttgggggcgtccgacccctggtccgcgcgcacttaaagctccgccttctcatcgcagtaatcgcagcggtagactccaccgccaacgctgtccaggtggaaggactggatcagaccggtctcgacggtggtgacgcagcgcgggttgatgcagcggatcacgccagtcaggtgctccggccgttcagggctgcacttatcgacaatccgcccgtcctccacacggttgacagtggcttgaggggcgacgaagcccaggaccgtcagattcagctcggagccaccttcgattttgatgatgtccttggagccgaagcgctcgctcggggcgttcatgatcagcgccaggcgtgttctggtggggtccaaacccaggtaatgcaagactttaagcgccctgccggcaggcacatggtcgatgattacgcctcggttgatgctggtgacttccatcaggcctccacttccttccacgcctggtatccaggcagctcatcacccaacagggccgcttccagggccattcgcaccagcatcccttcctttacctgctggaagtacgccgctcgcggatcctggtccacctcctgggcgatctcgttgacccggggcagcgggtggaggaccgccatgcttggcttggcgtgtgcgagcttgtccttgtcgaggatgtaggtgtcgcacaggcgcaggtaatcgtcctcgttgaagaagcgctccttctggacgcgggtcatgtagagcacgtccaggtctccaatcacgctgagcaggtcactggtctgctcatactcgcagcttggcgaggcgtcgatccggtcgagcacgtacttagggcagcgcaactcgtcagggctgatcagcacgaagcggacgcccccgaagcggctgagcgtctcgacaagggagtgcacggtgcggccaaaggtcaaatcgccgcacaagccgacggtcaaaccggtcagcttgccgaatcgggcttggatggtagccagatccgccagcgtctgcgtggggtgcatatgcccaccgtcgcctgcgttgatgaccggcacgctggccgccctggccgccaccagcgccgcaccctccttggggtggcggatagccaccagatcggcgtagttagacacgactttcagggtgtcggaaatggtctcacccttggaggcggaggacacttgggctccggcgaaaccgatcacctggccgcccagcctcagcatggctgtctcgaagctcaggcgcgtgcgcgtggacggctcataaaaaagagtggctaagacctttccttcacaggtcttagccacttgccgacgatggccgtcgatgtaggcggcccggctgatcaaatcccggatttgatcaagccccatatcgtccaaggtcaccaaactggtgcccgacagggactcgatcgatcgcgtcgatccagctcgctgatgtttggaatgcggagagaacttatcctgcccaaccttggggcctacccgtcgttcagacaacggcgcacctttcccgaaaaggtggccaccttgtgtgacctgtaccacagtactccatgaggccgaccaagccggcgaggcgtaggataagccgcttccctcggcgagtcattggccgtagaaaagacggaccatcacttcgcgcgagcggcgcatggccgccaggagctggttgacgaagtcggctccgcggtgggcgggatagccttggtaaacggccatggctcccagggtgtaagtgtcgtcgggcagaatgtcggcctggctggcccgccctgaccacagataggagccgttcctggcgccggtgcacagacgccagccttcccgaagggtcttggcgtccttcgacgcgatgagccccagttccttcaactcgtcgagggcttcaagcgtggatgtggtcctcaggcccgggcactggccggcgtattcgagttggtagagctggacggtccattccacgtccgagagccctccggcgcccagtttcaggtggcgatcgcgacggacaccacgcggcaagcgttcagcttccatgcgggctttgagcttgcggatctcggccacttgctccacggatgggggcgaagccggataacgcaggggatcggccacctcgaagaggaagcgatcggccaaattctcgtctcccgcggctcgacgggctcgcaggagggcctgatgctcccaaaccgccgaccactgctggtagtagcgccggcaggattccaaggaacgcacaataggcccaatcttcccttcgggccgcaaatccagatccaagtccaccttgggctcaaggctcagggtcattgaacccaaaatggcccgcaagtcatccgaaacggcccgggcgaaggcaccggcctgagcatcgtcagcctccgccgcaggttcgtaaatcagcatggcgtcagcatcggagttgaagttcacttccctgccgccgtagcgccccagagcgatcacgcagattcgggcgggcgcgtggtccagaccctgctgccgcttctggttttgcagggcccagtccagggatgattgcatcatcgcgtcgtggacgtcgctcatcccctccagacaggcgctttcgtcgttcacccggctcaaccagcccaggccgattcgctcaatctcccgccggcgcatggcgcgaacagcgtcagcgaaaccggccatatcgtcggcgtgccgctgaaggtaagcgtcgcacgagatggtcagcgagtccaagcctctgggttccagcaggtggtcatcccccagccaggtgaccgattccacagacttgcacagggcgcctgacaggtagcgggagttggccagcacgtggcagagtcggcgggcggccgaggaggagtcgcgcaggaaacctaggtaagtgcttttgttgccgaagcgttcctccagggtgcgccaacccagcagtcccatgtccggatcctgccccgctcccagccaggcgaatacagcgggcaggaggatgcggttgatcttagccgaccgggtcagcccccgagtcagggcctggacgtggcggagggcggcatccgggtcggcgaagccaatcgacgcgaaacgctccttggcggcctcgggcttcaaactcacctcgtcatcgtctagctgggcctcgattggaagcatgggacggaagtagatggccaggtggagccgacggacctcacggcgggtgcggtcgtagcggtcgaccagctcgtccgggtgcaggtcgaaagcccggctcagccggctcagctcctcattgctctccaaatccttcagggtgagcttgcgccgcgatttgaggccgccctggttatgggaacccaggtccgggaagaggtgggtgcgcttgagcagccacatctgctgacgatgctccaagacacgctcgaatcggtaatcagcggccaggcggcgagcgtggtgggaggagatgtacccgccagccgccagggcgtccaaggcgtccagcgtggacctgacgcgcaaactggaatcggtacggccatggaccagctggagcatctgcacggtgaactcgacatcacgcaggcccccagcgcccagcttgatctccctgtccttgagcttggctgggatcagcgtctccacccgcgagcgcatttcctgacagtcgtatacgaaattgggacgctgcgaggcggaccagaccagctcgtcgcacatggcctggtagcgctcgcccaggtccgcgtccccagccacgggacgggccttgagcagggcctggaactcccagttatccgcccatgacccgtagtattcgcggtgggagtcgagggtgcgcaccaagggaccgtccttgccttccggtcgcagggcggtgtccaccttccacaggggcggctcgacgacaccgggaatgaccgattggcagattcgttggagagccatggctatggcgctgccggtctccaccaggtcgtgcgcgctggaaccggtttccggccccgctggctcgaccaggtaaatcaggtcaacgtccgacacgtagttgagctcctgggcgccgagctttcccatgccgatcaccgcgaaacggcaggagtccgcccctggcaccttacggcgggcaatcgccaaggccgcgtccaaggtttcgccggccaggtccgacagggcgcggctgacctggggctgggcggcgaccgggtcccgggccctcaaatcatccgccatgatcgccgccagccgccgatagtaacctgctctgagcgcactgacggctggggcgtagttaatcctcttgcctgcgccggcggcatgcgccacctcctgacgcaagctagccccgcccaattgcccatgggccgctgccgccaccagggcgggccggtgttgcatcagcctccccatagcctgcgaggctccgagcaccaacaccaggcgattcaaggcctccggcctccgagccaagtgactcatgctcagttccgagccatattcgttggcctccgcgcccacaacggaagtcccaaccccttgcatcccaggctcgtaaatgccgctgccgggccaggcgggcgcgggggcgacgccagggagcgaaggagctggcgcaatggcgccgcccaggtgcgaggagttgggggatttaagtggagtagcgccagccggggatgatggaccaaccgcgagcgcactgtttacgcccgagggctcaagaggcgtggttccgccgccgtgttcctgcaaggcctgcgcttcactcccgtcgagggcccaaccagtcaccgccccggggcctgcgctttcctcccctatgtgcgtcagggcttccagcgccttgtcagggtcgcaggcatggcccaagtactctaacagtaaatcgacgccctgggagcccagccctaaacgcgcgagcttgtccaattcccgccgggcccgccccacattgcgcagccccgcgcgaataagcttgaccgaattcagatcgcccgccgctccatcctctcccgtcgccaccatcgtcagccgcctcccactctcgaaccggtcgcgcggttcatcccgttgccccgcctctaccgaatactcaccaatatatccgtctcccccacccaatcaatccaaccccagcccgacaactcatcgtccatcatcccctcccacaccaatcccctccccaacccgcccgaacccttccaaagccccgtccgataattttgggcaggtcctcacgttttcttatggatttcgaaggaaaaacgtgaggacctgcccaaaatgcattccgaatcatcaccgggcattgccgccgctcttttcgacgcgacaggctcagggcataacaaccaacgggcatcaagcccgtttgctggtaaggcgcgtccttaaagctgggtctgttcgataaatccactaagcatgccctcaagtatctgctgtgccaaagcacgcatcctgccttcgaggcccccttccctggctaacctccaccctgagccgcgaacccaataattattttgggcaaatcctcacggaatcaagcctgatgtcgctgatttacgtgcgaacttgcccaaaatgaatttagggatggcacgggcggaggaatttggcgaatttcagcgttgtgggtgctcaaccgcctggaggcgctaacgacgacgcgcagatagcggttgagtaggttcgaggcgcagagcggtcaggacttgcccaactccagctggtcgcagggcaccttggcgaagagggcacggacgttgcgccagatgcgccgggtgactacaggctggttcatcgagtaaaggtggattccgtccgcgccttgggcgactaaatcactgatttgctgggaggcgtaagctatgccggcctcctgcaacgcctcggtgtctccgccccacttatccagcaagcgctccgcggcgggaggtatccggaatccgcaggtcgagctcatgcgacgcacctgggcggctttggtaatcggcatgatgcccgcctcgatcgggacacagacgccagcctcccgtgcccgatccaagaagcgcatgaagtcttcattatcgtagaagagctgggagatcagatgatccgcaccagcatcgactttctccttcaaatgccgaatgtcctcagctggggagacggcctcaggatgcgtttcaggatagcaggcagccgaaatccgcagattcggcttagttcggcgcacgtaggcgattaaatcacaggcgtgggtgaacaccccagcaggtttccgcccttggacgcagtcccctcgcaggagcaggacagctgagacaccagcctgttcgaacatatccaaagcctcgcggacaacgccctcatccgagtactgggccgtcaaatgagcaacggctgatatgccatacccctggcggatggtccggcaaatgcgcgcggttgcggtacgatccgactgcctgccggtgccgtaagtcactgagatgaagtccggctcgagttcctcaaggccgtccaaagtgtcgtaaatcgtccccacagcggcgtcgcgcttaggggggaagacctccaatgaaaaaatcggttgatgcatattcatacctctcctgcatacgagcggaacgggcccgaaaagccctacgcgccgccgcgcgccttcaccctcacagcaggccggggcgagtgacgcctcctgcgcgccacccttccccgaccgaaaagcgccgaatcagcgctccaccgccagtctcgcccgcacagccttggcggcggccaccatatgctccaagctgggccaagtctcagcctcgcctcgggtcttgagcccgcagtccgggttgatccacaccttaccggcatccatcttccccagaatgagattgattcgctcctcaatctccccttgggaggggatgcgcggcgagtgaatatcgtagacgccaggaccagcctcggtctcgaagtgggccgcctgaatcgcgtccaagacagtcaagtcggagcgggaagcctcgaacgagatcacatcagcgtccatcgcatcaatgtcctcaatgatgtcattgaattccgaatagcacatgtgcgtgtgaatctgcgtggtcgggtcaacgccggaatggaccaggcggaaagcggggatcgcccaatccagataggacgaatgccagtcggaccgccgcaggggcagcttctctcgcagggcggcctcgtcaatctggatgaccttgacgccgctcgcttgcaaatccagcacctcgtcgcgtatggccagggccagctgttgggtctggagttcgtggctgacatcctcccttggccaagaccagttgagcatcgtcaccggaccggtcagcatccccttgaccacatgatcggtgcgggactgagcgtacgccgaccaacgcaccgtgatgggtcgagcccgcgagacatccccccacacgataggcggcttgacgcaccgggtgccataggattgaacccaagcattacgagtaaagaggaaaccgttaagattctgtccgaagtattcaaccatatcgttgcgttcaaactcgccatggacgagcacatccaagccgatttgctcctgtttggcgatgacgcggtcgatttccccagcgatgaaagcgtcgtactcctcctgaccaatctcgcccttgcgcaggcgcgcccgttcagcacggacctgggcggtttgcgggaaggagccgattgtcgtggtcggcagcatgggcagacctaacgcgcttctctgcaggcgctggcgctcggcgcgggctggttggcgggtgaaatcctgcggttgcagggctgcgatccgctccgctacgacggggtcggcctgcacgcgggatccgtcgaagaggacctggttgcccgccaatgccggggacgcccgtcggcccgcatcgtccatatccgccagatcggagacttccttaagctcgccgagcttctcaacggcgaaagcgaaatgccgccgaacgggttcatccagaccgtcctcgccatccaggctgaagggtacgtggaggagggaggaagcggtggagaccgccaggtggtcagtcacccgccctaccgcgtctagcagccccagggatcgggcgtaatcattgcgccaaatattgcgaccgccaatcactccggcgaagatcgtggtcccctgcgagaccccgcagcgctccagagcggcgagattgccttcccgcccttcgaccaggtccagtccgattccgtcgaatcccatgctctgcagcacctcgtagcagtcgtccacatgcccgaagtaggtttgcaggaggagtttcacggccccgctgccattgtgtcgcgcgggcatgattcggtcgtagagcgacttgaataggcttatgtcgccgtcctgcttgtccaggaccaggtagggctcgtccagttgcacccattcggcgcccagatcgatgaatcgcgtcagcacctcggcgtagaccgcagcaaccgaatcaatcaattcgtgacgataatccaggcgctgaccttgcgggccccgtgccagtttcaagaaggtgtagggaccaaccagcaccggtttggtgatacgccccagctccttggcttccttgaactcgtcaaaaggcttagtcgagctcagctgaatccgggtggaatcctcgatctcgggcaccaggtagtggtagttggtcgtgaaccattttttcatcggcagcgcggtcacatcgccctgaggcccctggtagccgcgccccatcgcgaacagggtgtcctcctctgcaagccccagccgccgataccgggtgggcacggcgccaagaaggatagcggtgtccagcatctggtcatagtaggagaagtcgttgctgggaatcagatcgacgccctgatctgactgtatccgccaatgcgaagcccgtaaggccctgcccgtggagcggacttcatccagatccgtgcggcctttccagtagccttctatggctttcttcagctccctatgcgcgccgatacgtgggaacccaacgacggatgtaatcaaagacatagaccctccaagtctgcgctagtggctaggagtcagcctagcagcggcgcggctgggcctgtaattaggagaattatgatgtcgtcataagccggccctatacccccagcacttcagggggggggtaggagtcacacagggtacttgcgcaggtcgttgggcccgactgtcccaagcaaatcagccgtggacgggctccagtcccgcaggggctgagccgctgcaagaacagccgcacaggcaggcggcatgcccagaccaagaagccctagagcgccctggtcgcttgccggatcggcaaagagttgggcgcaataggagacggagggctcatgagtgacgatcagcaggaagcgctcctcctgcttcgaggccacgagctcgtccaagaggccctgggtgccgcccgtatagagactctcccggtagtccaccgaaggcccatcgccgaaggaactaagcatgaggtcgagggtctgcctggctcgcaatgcgccggagcacgcgatccgatcagggatgagacccaatgcagacaggctgcgtcctactgtttccgcttgcttccgcccctgcaggctcaagggcctggagcggtcccctcctgcgccgcacggctcggcttgagcatgacgcatgatgagcaacaagtgaccggagctcttcgcttggtccgcaagcgcctgcgggtccaccttcatggctcctcctgtctgcgtgcggcggcctcgacttgggcctcctgccgctccaagtcgcgtaggaccttacgcagtttgcggtcggaaatgtcgcgcaggctcaaatcggaccagcctccatcggcacctgcgcccgcgcttgcctggatattcggctgctccgggatggtttgatcgatgtctgcgtgcacatttttgttgccgcgctcccgcttgtgcaacgcttggaaacctgccgccatcgccctggtcaccaccaggaatccgctgtgcccgatcatctggtgctgcggacgtacggcgagcccgtccgccttccacccgcgttccagggtctcgcttatctccggttctgtccaggagccgctggcgcgcaaggcttcggacaggcggcccagctgggtggccgtcgtcacgtaagcggtcagcacgcccccgggggccagggcccgccaggctgcatccaaacggttccaagggtccaacatatccaagacgattcggtcgtatgcgcctgcgggcaggaggggcgccacttggtcaaagtcgccgacgcgcaggtcccagcagtcgggtttaccgccaaagtagacggtggcgttgccgacagccacgcgggcgaattcggcgcgcagttcgatggtggtcagcccgccttgcgagcccacggcatccagtagtgcgatgctcatggcccctgacccggctccagattccaggaccctcatacctgagcgaatatcgccagccagaaggacttgggctatgtctttggggtacatgatctgagcgccccggggcatggagagcaggaagtctgacagcctgggccgcatcatggtgtagacccatccgccaaccgctcgcgctgatttccacggcttgcgcggatcgttccctgcttcgccggcaggatcgctattgccgcatgccttgagttcctgggcggaaatcgttgatacgagcgagccttcgctcagtccgatcaacctgtcgtgcgccaagaagccgcggtcggtttgggtcaccgcgcctcgttccaacagcagggtgagcatcttgcctttgcgatcggtcagctggactttctcacccgcccgtacaggtccgcggcgtactgccatcagttctctcctccgttcatgaaccgcgcattgccacgccaggcgggcaagccttccacctgcgcaaaccgttcacggggagcctgccagctgcccgcctcgcgtctgctggaaactccgccatagaacccattgaaacacagcggagggtcaaccaaacgacgagcccaaccatccagcacgcaccctataaagggcagcagccaaagccgtcgcacccgcaacaccggatcatctgccaacttcttgaacaccaccgtcgctttccttaccccgcccggacgaatccgcacacccagcggaggggatgccgcgtaagaaactatgaccagcatacccctgagctccacccaccccatcctcatttgctcgccaaatccctccccacatccccacaccatcttttcctattttgggcatcccctcacgcagaaaggcacattcagcccgataaatgtgatgagctgcccaaaataagacatcatgaaaaccgagccaagacccaaggtgatatgcccgcgcgatgttggagccgactcaatccgtgcgcaccataagcccaatcagcgagccccgcatcggcaatattccatttttgggcagccccctcacgattttcctgtgaataatgcctgattccgtgaggagttgcccaaaaagaaacacgaggagggagctccggccagaccgcgtcggaagcagagtcgcataggcgactttcggagccccgggcggagatcgagcgagatgtaccgggcgacgtttacggagaagaaaaagggccgcgacaccgctagtgcggttcgcggcccgagcaagtccaagccgactggctgtcagacggcagtgccgtacgaatccaagcgcgggttctccttatacgaaccaccaacgaagaacaggctgatgacaccgacagtgaacaccgcgcaaatcgtgataatggcccacatcggcatattcggaacccacatcgcaaccaggaaggcgataatcgaaagcacgatcaagcaccagctgagcaggcggaaccaatgccgaaccgaacgcggcttctcgaccagtttcggatcgcgcagactaggatcaacttgctccgccaccggggccaaatcattacgaccactgggtttccactccccgttatcgcccgcggccagtctgcgagccttctcctgcaacgcctgctcgtccaacatgccccggcggctcttcatcgccccacgcgtgtattggtccccatctcccctgcgagcgctcttcgcacgtgcccgccgttcagcacggttcgacatcaaatcgcctccacgtttagtaagctcttccccggtattgcctagcagaccttggccccgacgagcagacggggaaggcctcgcgtaagcataatattagaccagaccccaaaccgcgagacaagggtaaatccccgacggcgcccaaaccggacctcacagcggaggccatgctttaccctgcaagaaaccggcagcggacccgcgcccttaagcgccaaccgcttctagcacgtcagcgatcaaatcgtcattgagcaagcggccgcggcgtgttggtacgattcgcccaccacgcgcctgcgccagcccgccatgtaaagcaggcgcgagccggcgtaagtccaagcgcccgcccgctaagcgctccagcttttccagtgacagtccttcacgaatccgtaatcccagcatcacgccctcttcgagtcgttcgcggggtccaatcacttcgccgccagaccagggctggcgctcctgattcaccgctctcgcccaggccctcggatgccgaatatcccaaacgcggacggactccccagcaactttgctgcagtccgcggcgggtgaaggaccagcgaagcgaaacgcctgcggaccttcgcctgaaccgtcgtcccctctttgcccggttttgcgccaggcaccttcctcgctcctcccgccagcactgccgccagtctctgaaatctctgaaaccggatccagctcgatccagttatagtgcgaatgggctccaggtccgattccggcccaatccacgttgcgccagtagcctaaattatgacgcgactcatggccaggccgcgcccagttggagacttcgtaccattgcagccccgccgcttggaacaagtcatccgccagctcgtacttgtcggcttcgtcatcgtcatcaggatgggccagttgacctgccgcgacctgccggcccattttcgtcgttggttccagggtgagcgcatatgccgaaatatggttgacacccaaggagagcgcctcctgcacgctttgttcccactcgtcgatgctctcgcccggggctccgtaaatcaggtcaacgctgcactccaatcccaaacggcgtgcggctgcaacccccgcggtcacattagctggggtgtgcgtgcgttccaggatgcgcaggacgcgtggcacagccgattgcataccgaaagagacacgggtgaaaccgccttgggcgagttgggcgaggtagcgctcgtcgacggtgtctggattggcctccgtcgtgatctccgcgtccggctgcaaaccccagagggaccgtgccgcatggagcatacgcaccaaatcctccgccggcagaaccgtaggcgttccacccccgaagaacacgctcgacagtgcgggttccacgagcccgtgctcttcttgccaatcgcggatcagtcgcatctcccggatcgccacactcgcataaccacctcggctggctccttcacccaagtcgactgcggtatacgtgttgaaatcgcagtacccgcaccgccgcaggcagaaaggcacatgaatatacaattcgaatggcttcgccgcctgtctcgccgtagcgtcttgctgtcgcttcatcttcaccatcttccattcatccacgtccagcccctcatatccgcctcacccattgtcatcttcccctccctcttcctccgccgatccccacgtgcctgcttctttcccattttgggcggttcatcacgaaaatacgcgttttcggtctcaggaacgtgtggacttgcccaaatattgcagttgagaggtttaccgtcaaatacggcagcatgcaccgagcgacgggggagggggggtagagcgcaggcggcgggacagccaacctcaaccgattgcatattaatccaacaaggcaaaccaaggcaatcacagccttcgcatcaaccacaacgagctcgaggcgtcctgattgcaccatgaccgtaaccgccccagagggttggtcactggtccttctgcgccgctcgaatcttgtccttgctgtcccggtcctccgcctcgccggtgctcaaagccgcgatgaaagcctcttgtggcacctccacatgaccgaggagcttcatccgcttcttacccgctttctgcttttccagcagcttcctctttcgagtgatgtcgccgccgtagcatttcgccagcacatccttacggagcgcccgaatggtctctcgggcgatgatgcgcgaacctatcgcggcctgaatcggaatctcgaactgctggcgtggaatcaactcgcgcaacttcttggtcatcataacgccgtacgtataagccttatcccggtggactattgaggagaatgcgtcgatcttctccccttgaatcaggatgtccaccttaaccaggtcggcggcttgctcgccatcctcgtggtaatccaggctcgcgtagcctttggtgcggcttttgagttgatcgaagaaatcgaaaacaatctccgccaacggcatccggtagtgcatttcaacccgttccgggctcaaatactccatggtccccatctgcccacgatggtcctggcagagatccatgaccgcgccgatgaactctttgggagtgatgatatccgcagcggcgacaggttcgacgatacgtttgaccttgccttccgggaactcgttgggattcttcaccatgtgctccgaaccgtcctccatcgtcacctggtaagtcacgttcggagcggtggaaatgaggtcgagtccgaattcccggctcaagcgttcggaaacgatctccatgtggagcaaacccaggaatccgcagcggaagccgaagcccagggcgacagacgtctcaggctcgtagaccagggccgcatcgttgagtttgagcttgtcgagcgcctcgcgcaactcagggaattgcgcgttatcgattgggaagagccccgagtagaccatcggctgcgggtcccggtagcccggcaacggctcatccgcctgccgggattcgagggtgatcgtgtctcccaccttggattgggccacgtccttgacgccggtgatgacgtaaccaacttcgccggcgcccaaggctttggtggctatcatgtccggactgatgacacccaactccacggggtcgtgcacggtgcccaggctcatcatcctaatccgctgcctggctttaagctccccgtccaccattcggatgtaggtgacgatgccgcgataagagtcgtataccgaatcgaagatcaaagcccgcgccggcgcggcggggtcgccttttggcgccgggacttccgtaacgatacggtcgaggagctcgcggaccccctcgccggtcttcccggagacgcgcatcacctcgctggtatcgcaaccgaggagattcgctatttcctcggcatgccggtcgggctccgctgacggcaggtcgattttattgagaacagggatgatggtcagatcgtggtcgatcgccatgtagaggttcgacaaggtctgcgcttcgatgccttgcgtggcgtccaccagcaggacggccccctcgcatgcctccagcgcgcgcgacacttcgtaggtaaagtccacgtggcccggcgtgtcaatcatgcccaaagtgtactcgacgccgtctttcacccacgggacccgcacggcctgagatttaatcgtgataccacgctcttgctcgatgtccatgcgatcgaggaagcgatcatgcatctcccgctgcgataccactccgctcagttggaggattcggtcggcaaccgtcgatttgccgtggtcgatgtgcgcgatgatgcaaaagttgcgaatcagcgcctgattagtgaatcctggctggttggtaaaggtaaccaccgggctcctctcctcgcaatgctcgaacaactcatcctatcccgagccctaggcttttcccttagtccaatgcttttcttccctaaacgacgactaagtgcggcactcctttcatcctctcaaaaacccgactctcccttaccccttcccccccccccccaaaaaaaaatgactctgtttacattttgggcagctcctcactagttaatcgtttcatttgcctgtgtaccgtgacgaattgcccaaaataccagttgcgcggtcatactcggttggctgagcgacagatgacctgattgggcagagaagagaagccttatccgattgagatctaagcgcggcactcccctggtttgaaataaagcaagccgcatcacggatttagttagtcgagattcggctcgcatggctttgctctggcatagaataatcgtgtcccgcaaaggagaaaagaatgagactgaggccctaccgcaagcatgaagacgatgctcgtctactcgagttagctgaactgatagccgtgcgcgggaatccgctaggtctcagcatgctcgactacaagctttttgaacgtcagctcctcgctgaacaacttatggacgagcgcaaacaggacgatgactccatcattgtcgccgttgcggattcagccgaggaattgcagcgaatagtcccccctcaatcctctcccgagccagcaggcagcgccaacccacccaggactaagccaaatccgtcgcgagtccaaggccagagcagtaggatcattggcttcatcaacctttcagtccgcccggaccccaccagcggccgtccatgcggctatatcagccagctgtgtgtggatcagcgcttccaaggcgagggcatcggaaaatcattgctcaccgaggcgaagcagtgggctaaccgcaacggcttattcaagctcaccgtcaatctttccgcagcgaacgagagcgccatctccttctgcgagaagctaggccttcgcctcagtgcggtcagtatggaggtgtcttgcgcccaacctgattgctgatcgctatcgttccctggttttccaggccgcatggtagtattatttttcgtctgtatcggtagcacatgtcgtttggagcaacattggcaaacattaaatcgcagaagaagcggattcgcactaacgagaaagcgcatctgcgcaacaaggaagtcaagagcgccatcaagacctccatccgcagcgtccgcaaggccattgacgaaggcgacaaggcgggcgcgcagtccgctttctcggtcgcagctcggcgcctggacaaggcggctggcaagggtgtcatccaccgcaaccaggcggccaatcgcaagtccggcctcgcgaccgctatcaacgctatgtgattgctgcagtcttccagcaaaggcgtccactcctcgtacggggtgggcgcctttgtcgtaccaccaatggctatggcgctcgagcttatgtctggaaggccacatatgagagccaactctgctcatatgctcactattacagattcgaattcacgataatggtacctacaaggcatgcaccgcttacttatcagcaaatcgagaacaagcgaaacatgagtcacaaagccggttcagcgcccatgaatgccccaacgaactagtagccgttgtccaagagcaagcgcaattctccttacgctgcccttgcgggcaattgataacgcttgctaaaccgtggtctccaacaaggcacgttaccattcgccgaagaaatcgcctcggattcgccgcgcagtcaatccaataacgctaatcctctgtaaccctctcttcgcgactattttggtcggttcctcacaagtgaaacgttacagcctgagctatcacgtgacgatccgcccaaaatgctaaaaaagaccaccccctaaacatccgttctcgggatagtccaacaatgcacagggagttcggcgcagagtacccgcatatatcggttgcctaagaaaaggtagtgagcgggaaacgtggcttgaatgcccgaatgggtggacttatccacattcgaccacattggtcaggacgatttggaactctcttcgaaccacccatagactcaaacccatgaatacgaaccaagcatccgtcgaacagctcggactcttgtccaagagcagaagatgctgccttgtgcctgcatcgaaccgcgagcgcatgcgcctgcttcgtgccgttaaacgaggcagcgttaagcggcccaaaccacatctgtatgcgccaacgccctattgggtttcgttgacacggtatgagcaagccctccacctgatccgcgccacagctcgccgccggccagagtggacattctgctacctatccgcagcgcttgtctggggactgacggaaacagttttcctgcatgcgcaaatgcatgtcgcagctaagaaccacactcatgtccgcgtcggcggcagcataaaatctcacttctgcctggtcccgaaacccaagaaacgcaatggcgtatcagtaacgccgctcgtgcagacagtctatgactgcgctcgacggctggattacggcaatgctctggccatctgtgaaacggccatgaggttgtacggggtgaaacgccgccaactggaagcctacgccaacgcacggccccacacctggggcagggatcgtgcgctctatgtcttcgcgcaagcagggcctcttagcgaaaacggcggcgagtccatagcccgagcccgcttcgatggctgggggtatgcggctcccaaacaacaagtctcggtcgagcgccccttccaagcaggcaagaggctccggctcgacttcctgtggaccaccaggaatggccgattggtcgccggtgaactggatggccgggagaagtacatcaatccagccatgacaggtggcggttccgtggctgatgtgattttgaaggagaaaagacagggagacggaattatcactgttgggttatgtgattgttcgcttctcctacaagcacatacaagaaaggcatgggattctagtgcaacgaaaactggatgcggcgggagtaccgcgattggacgatcaactgatctcagagaaaacggagaaccaggaggtccaccgtttattcggcagctgctgggatcagacccacacctgttgggccggcatgactagccaataccgtcaactcaggcaagcacgcagccatgacagccgacggccgccaaaccgtccgaactttagggcacggcgcaaacccccggaaatggaaaccatacgttccttctgaatttctgcccggagcgggcagtctaattggaacgactgcctgaccggcccctgctgttcccacactcctgttctggagttttgtcaagcggcgcaaaaatagcagggtacggcagaagcgcatctgcgaaaaaggtggggcgccaagccggcagcgcgtgccaacgcttagcccccaccctgaatacggcggaatcagcagacgcgccacatccaattatggggatcttccccctcacctagttgaatgccaaggagctcgtcgcgcagatgcatggtcaagggccccgagcccccatccgcaacggtttcatcaaagttctcagacttgaaccgtcctatgggggtgatgattgcggccgtaccgcaagcgaatacttcagtcacttccccgctacgaatgtcatcgagcaagtcggtcaacccaatcatagtttcagtcaccgcatgcccctcatcttgggcgagctgaatcacagagcgacgcgtcacgcccggtagaatcgttcccgttaggcttggcgtctctaagtgtccgtccttatggacggtgaacatgttcatcccgccgagctcctccaagtaggtgccggacgccgcgtcaacgaagcaaacctgttcgcaaccatgttgagccccacgattctccccaaccagtgaagccgcataattaccgccgcacttagcaaatcccgtgccacccggacccgtgcggaaccacctgtcctccacccagatgctgaccggtttcacaccgcccgggaagtaaggtcccgatggtgaggcgatggcgcagtaatccacctgatgcggtgccctgacgccgagatagcactcggatgcgtacatgaacgggcgcaagtaaagcgtgtactcacgccttgttggcacccaggccgcatcctgcttcacaagcgcggcgaccgaacccaggaagtcctctgtgctcaaggccggcagagcgaggcgcttcgatgagttttgaaagcgctcagcgttggcatccggcctgaacaaccagatagaaccgtcggcatgatgataggccttcagcccctcgaacacttcctgcgcatagtgcaagaccgttgcagcaggatccaatttcaacgggccataggcttctactttcctatccgaccagcctccatcttgtttccatgtcatacgtaccatactgtcggagaacagctgtccgaaagcgggtttgtcaatcattgcctcgcgctgttcatcggaggctgggtgctcgttaggcacgacctcaaacgttgacgcgagtccgctcaaatattctggatcatgatgtgattggctagtcatgtgacacttcttctcagcaaataggaagttgcagatacagacctggccctacgcttgtggcgattcgccggtataaggtgcatcttaggcgtcagcctggaagagcacatcggaatagtccacatgttgaccataaccgtctcatactcaaaacgtaaagtctcattaagtccgttcctcaacttccaactccgcttgcccgcctcaccccgtcattacgttcaccccagcgagccttctgattgcattttgggcaattcttcacgaaaacaggaggacaatcatgagttttcatgagcatctgcccaaaatgccggttttggaatgggcgtgccctcgcgcggctcccttacgagggctcgaagccgacagccggcattctgcgtttttgggtaattcctcacgaaaatagtcatgaatccactgaattcagtgaagacctgcccaaaatgataaggaaggttgcagttgttagtcgcgacagttgcgtggggcgtgaggctagcgaggactgtggggatttgcgcattgaaggggctaggggcgtgggtgcgtatggggttggggcagggaggggggggggtacaggggtgtatgaggggggtggaatgcgctcgggggccgcgcttgtcgttgtgcggcccccgaggattgagagcgatgacgggtctatgtgaacggcggttgttaggatgcctcggtgacccgcatgtttcggctactcggccttgtcgctcgagtcagcgccgtcggccgtggcattctccgcggcggcatcgccctcggcggcggcagcctccggcgtttctacagactcttccttcgggacctcaacggttacgacggaatcctcaggatcatcgataaccagctcagcgccttcgggcagcttcagatccttggcgagaatcttgtcgccatcggcgaggccttccacgctgacgtcaatgcgctcaggcaggttggccacatcggcgcgaatctggaggttctgcatgtcgatgaaagcaacagcagcgcccttggtctcaccgctgatgaagaccggaacttccacaacgaccttctcgcccgcacggacctcatagaagtcgatgtgctccacctgacgcttgacagggttacgctgcacgtctttgacgacagccatcttggtctcgtcgccgaacttaatcgtaaacagggcgttggcgcgacgcaacgccagcgtggtctcccgcatcggcagcttcacgaaggaaggctcggcaccgcctgcataaatagtagcgggaatctgctgggcaacgcgcattcggcgagcggcccccttaccgaactcggtacgctcttcaccctcgagggtaatcgtattagccatgtcgtctccttttatcagtacagccaacggtctgacgcatcgacgcgccgtatcccgtcgccagccaaaaggagcttgcgaacaacgccgagtcgataacggatgaacgcgagtgcgtcgcatccctcgccaaagcaactactgaactatagcatagcgcccagacctggaacacccaataatcattgtcagtaggtcaatcaagagcaacaatcagcgaatcgacctgcgttggaacaagcaccggtcaacagatagggctcgagcgggggggggggatcctcatccctgctggcaagccacgcgtcaacctgcgcgtccattcatgcctatgtcgcgcgtcgccgcccctcacttctcgtcggacgtaaccttggccgcattgccactctgactgggcgtcggcgtcacttgcggcgtggaagacggcttgtcgctcgggctgggcgtttggctgggctgctgcgaaggctgcgctgtctggctggggcgaggagacgcgccgttgccgttgccttcaccacccatcgtcggcgaggacgagggagagggggcgccgctgggggtttcctggggttgagtggtttcagtggaaggcgaagaaccgttaccgtactgatcgggcgctgttgagcttggcgcaggcgtttggacggtttggttggggcggacaatatcgcggaccacgtggtcggtgccctcccccttggtcagcgcattgatgattagagcggaaatgagtaccgcaatcagagcgctgacgaccgacacgatgatgaccatccgcttcttgcgctgaacctgggaattctgcaacagatggcttgcaggcctgttcctggcagcaccaccggaacccgcgaggccagccggaccggactgagccgagcgggctgtgcgcgcgccaccggttttcgcactcgaagcggtacgtcccgcgccaacggcaggcatgaccgtcgtcttatcgctgccatcgatcactggcaggacagttgtctccccagatgcgcccgtatcggcgcctgtcttgccggtcgccgcccgcgcgtctcctagcgtgcctgcccgcccgcgggcaggaggcagcaccgtggtagcgctcgcatcatcatgggctccgtcctttcctgcatccaccgcatcggacccggcgtcttcttctccatccgcgccaatcacagtggtttggagcttatgcgtggaggcatccagcacgttcttgtaaatctgggaggcaacagcggaaaccacggaaccgaccgctacgccgatggcagaaccagcgatgccaatcttcgctgataggaaaaaggaagtgaccgccgccagtgctccagcgaacacttgcgcccaagatagatcgtgaaagaacctcttcactctcactcctttcctcacagccacaaagacccgtgcgaatatgcccaaacacgaccgctaccaagtgctcatgagcgagccgactacggtaggccagcttgacctgcaccgctggcccatcatagcccaccggtattatccgtagctagtccgaaactgaccagggctgggagaagcctgcttccccctattcatcgcatccacgaccctgtgagccacgatgcaataaaccgccgctttctcagcctcttcgcatcccacgcgctcaacggcaggtacctcgaagaagtatctgacaacggaaataatctgaatcgccgctgatgaaacggctgcggaacaagcctgggcgccagaaagtcaagggcgggaaagctgatgcttgttccaagaaaacttgtgcaagcgctaggcgaccccctgcaaggacaatccaggaagccaacccccgcgatacctcagcaagaccctgggcgaaagccagttagtccaagctcacggcgtcgttcggatcactccagtcgacctggcgcgcgatgaccggcccgcggttgtagtccagcagactccagcgcaagtggccatcctccaacgccctcggcacgaacctggcccagtgggcgttgcgcatggatcccaggctcgcgaagtccgggcggacctggctgatgcccatcagggtctgaatggtctgcgcgatccatgagccgtgagtgaagacgaacaggtcggtgtcctcaccggcgctaccaatccagtcctccaaggcttccaggccacgttgccccacagcgctcttgggctcggcaccatgcttgagttcgccgccgccggatagcatccaggagtgaaaatcctcaggccaccgctcgcgcacgtcttccgcagtctcgccctcccaggagccaaaactacgctccctgagccgctgatccgcgtgaatcgtcagtcccaggggctcagcgaaagcctgggcggtcgcgtaggcgcgagccaggtcggaggcgatgaccagctgtttgcggtccggcttgttttctacgtagtcctgcctgagcgcctcaccggcttgcttggcttgccaaagcccgaccgaattcaaggggatgtcgatctgcccctgcatacggtggacggcattgtagtctgtttgcccatgacgaactaaagtgatgctacctacgtgcctgcctgccgccgacgcttcgctcacctcattcacgcccggctcgccttctggtcaaagtcaccggtggaaagggggtgctccaggtccaaaggcaccggcgggcagtcactccacaagcgttccaaatcgtagaacttgcgtgcctgcctatgcatgatgtggatgacgaagtccgagtaatccagcagaatccacttagcctcgtccaaaccctccctggcctggggagtcagacccagctcatcgtgcaaatggcgctcgatagtgtcagcgaccgcaagcacatggcgctcattatcgcccgaagcgaccatgaaaatgtcagtgattgccaaaggctgcgacacatcgaaagcgatgatgtccatagcctttccatcgttagcggccttagcagccactcgaacggcgtctattgattcctgcagagccggcacaggcccacctttcagtaagagcgggaccgatcatcccgctggtttttatcctatcgcgtccactcccctcattcggagtccgctccgctgccggcacctcgctcccatgctggtttccagttttccacaacatgttgggaattttcggagtacaccatcgccccgtccggcaccgtatgtcggattaccgcgccggcgcctgtggtgacgccgtcgcccacgtggaccggagcgacgagcatattgcccgcccccacgtggactccagcgccgatttcggtgcggttcttatggacaccatcgtagttggcggtgatcgtgccaccgccaacattgcttccctcgcctatatgcgcatcgcccacgtagctcaagtgcggcaccttggtgcctttgtcgatgctggccttcttcatctccacgaaagcgccgaccttggttccctcggccagctcattgccgggccgcaagtaagtccaagggcctatggtcgccttcgggccaatcacactgccctgcacacgggagcgctccaccgtggccccttgtcccacttcagcgtcgatcagcgtagtgtaggggccgatgaccgcctcatcagcgatcctggttcccccttgcaggaagcagccgggcaggatcgtcgcgtcgcgcccaatgcgcgcctcatcgtcgatccatgtggtctctgggtccagaatcgtgaccccttcgcgcatccaccgctcgcatacgcggcgattgtgagcctttgccaagtgggccagctggacgcgatcgttaaccccctccacgctcagcgggtcaggcgccgggtaagctcccacacgccccaggcgacgggcggcctccaaggcatcggtgaggtagaactcgccttgctcgttgcggttgttcaatccggcaatcgcctgagtcaacacgtccaactcgaaaacgtagaccgaggtgttcacttcagtgaccgccagctcggtgccggtggcgtctttctgctcgacgatgcgtaggacctgcccgtcctggtcacggatgatgcgcccatagcccgtagggtcgtccaagcgggtcgtgagaatcgtggccccatcccccagcctgacatgctggtccaccaggtctcgcaaggtgcccgcgtcaagcaagggcatgtcggaggcgacgatcagcaccctgcctttcggatccacgtgaccctccagcgcgttcaaggcgcactgtacggcgcggccggtacctggtatctcgtcctgctggatgacgctcacagcagggtcgtaggaacgggccgcctgagccaccctctcgccctggtagcgcacgaccaggcccatgatgccaggctcgagctggcgcactgaatccatgacccggttcaggaaagtcttgccagccagctcatgcaggaccttgggcttggaggaacgcatacgggtgccctcacccgcagcgaggataatggccgctgacagggcttgcgaagcgctcaaagctccacttccccgctctgagcaatcggaatcaggtcttgaatggaatcaaccacgcgatcagggcggaaggggaaggtttccacctccttgcggtgggtgatgcctgtcaggaccaggaaggtgttcaaacctgcttcgacgccagccaccacgtcggtatccattcggtcgccgatcatcgcggtggtctccgagtggccgcccacccggttcagggcggtgcggaacatgatcgggttgggcttgcctacgaaatagggctcacggttggtggctcgggtcaccagggccgccactgaacccgcggcgggcaagatgcccgaatcgctggggccggtcgcgtcgggattggtgcagatgaagcgggcgccgcccagaatcagccggatggctgtggtaatcgactcgaaggagtacgtgcgggtctctcccaggatcacgtagtccgggtcctggtcggatagaatgtagccggcctcgtgcagggcggtggtcaaacccgcctcgccgatcacgtaagcggaaccgccggggatggtgcgcgcgcagaagtcggcggtcgccaaggcggaggtccagatgttctcctcgggcacgtcaatgccggagcgccccaaacgggcggagaggtcgcggggcgtgtagatggggttgttggtcaacaccaggaaacgccggtcgttctgcttgagggtctctatgaattccgccgctcccggcagagctgtgttctcgtggacgagcacgccgtccatgtctgtgagccaagtctcaatttgtttgactgccaaaccgtgtcctttcagtcggccgccgtcctgcccggggcctgccccgaagggatcggcgagctgcaagctcccccacctggattcgaaccaagactaagggttccaaagacccgtgtgctgccattacaccatgggggaaggacaggtttccctgccgtacatcattatgtcataccccctggattcgccacgcgggcggcgacacgagcgccgaatccagaggctggtctcaggcgaataggaatccctgcccgtggtgggccgggtaagtgtcgaacaagcgggccaccgagccatcctcgaagaccgctttaatggctgaggccagcaggggtgcgattgagaggacggtcaacccgtcccaacgcttctcctcgggaatcggcacggtgtcggtcaggaccacctcgcgggcgtcgcaggccttgagcctgtccacggcggggccggacatgaccccgtgcgtggcgacgaccgtgatggacttggcgcccgcctcgcgcagaaccgagcaagcctgggcgattgtaccgccggtatcgattaaatcatcaaccaggacgcaatccaggcccctgacgtcaccgaccacccgattggcgaccgccttgttgggctgggtgatgtcacgggtcttgtgaatgaaggccagggggaccccacccagtcgctgggcccactgctcggccacacggatgcgcccggcgtccggggagacgaccgccgcgttgcctaggtcaagcctgtcgcgaacatagtccaccaggaccggcatggcgatcaagtggtccacagggccatcgaagaagccctgggattgggctgcgtgcaggtccacggacatgatgcggtcggcgccggctgccttgaagaggtcaaacatcaaccggcaggagatgggctctcgaccgaggtgcttcttgtcttggcgagaatagcccagcagggggcagaccgcggtaatggaacgggctgatgcgcgcttgagagcgtcaatcatgatcagctgctccatgatcgacttgttaatcgggtcggcgtggctctgcaggacgaatacgtccgccccgcgcaccgactccgtgtaccgcacatacatctcaccgttggcgaagtcgtacgctgtggtctccaggacctcgatgcccagctggtcggctacatcggtggccagcttacggtgggtcctgcctgtcaccaggatgaggttcttgccgggcctgcctttgaggattgtgctcaccatatctccaaacgttggtgtcgttgaagcaacgactccatggtagccagcgacggtgacagatcggcgcggccgtgtcagctttgcccgcttcctctcgagcgtcgcggcttaccccgatagagcccatgcttgttgatgtactggaccacgccgtcgggcaccaggtaccaaaccggcatgtcgcgggcggcccgcttgcgtacgtcagtcgaggagatcgccagagccgggatctcaatcatgtcgacggtgtgggccggtagttccaagcctttgagcgatgaggagtaaccgggtctggagacggccacgaagcgggccagggaccacatttggttggcttccttccagcgcatgatctcggccacggcgtcggcgcctgtgatgaagtagagttcacaatcaggtcgcatggcgtgaatgtcacgcagggtgtcaatggtatacgtcacacccggacggtcgatgtcaacccgggaaaccgtgaatttgggattggacgctgtggcgattacagtcatcaggtagcggtcttccgcgctggtcacctcccggtccagcttgaaaacgggcctgccggtgggcacgaaaaccacttcgtccaggtcgtagacccaagccacctcggaggccgcgaccaagtgcccgttatgtatcggatcgaaggtgcctcccatgatgcccacccgcctgcgtcgacggcagcgcttggagtgggctggccgcgccgacgccaggccagccccttggtcggttgcgctctcctgcgggttcagctgggccatccggcgctcgatgggaggcgccgccggacgacggttggccttggaagcttccacgctcaccgttcccccgcgtgacccgcgacggcgccatcaggcccttccgcccggtctgtggcggcgacgtccccatcagacctcgccccgtcctggtctgattgcccctgagccagccccgtgcctacgtggctgttggtctcctcctgctccgggtgctcctgcatctgcttgacctcctggggcgaggtgacctgatccgggtcgatgcggctcatatcctcattccactcctgctgcaccacctgatgaatctcccggtaagtgggcaaggggaagtcgggctggaagtggcggcgcacctgggccacgcactcagtgatcgtgaccagggaacgggagagatcatcaatcctcccctcacgctcaagcctacggaagcctggaatcttcccctccatttcggcgatgatctcacgcacctgatccagctccccatcagccagatccaccacctggtcggcgtcctcatcgggccagccgatcaggacagcgtccgcgtattccaagcaagagcgttggttcgcgctaggaatgccgtcctcgatctgcaccaggtagacgtatcgtagctgactgagccgttcggaggcaaccctcagccagatcttcggattgcccgcctccttggccttgagctgttcaatggttccgttcacgcgcgcacctgccctgtcccgtagcctatccatttggtcgttgtcaactcatccagccccatcggtccgcgggcgtggagcttttgggtggaaatgcccagctcggcccccataccgaattcgcctccatcagtgaagcgggtggaggcgttgaccatgaccaccgccgaatccacctggctggaaaaatgctcgatcgccgcgtaatcctgggccaggatggcatccgtatggccggtggagtgcgcattgatgtgggcgatggcctcctcgatcgaatcgaccaccttgacacccatgcgcaaggccaggtactcctggtcccaatcctcggaattcgcccgcctaaccagctcgtccggcaggtcgcccccatcagcggcgagcaaatccatgctgatcgcgtccaaccggagctccacatgggcacctgtcagggcctgcgcgatacgcggcaggaagcgggccgcgacatcgcggtggataatcagcttctcggcggcgttgcagaccccgacgcgctgtaccttggcgttcatgatgatggggatagcctgatccaaatccgcagaacggtccacgtatatgtgcacgttgccggccccggtctcgatcgtcggcacctttgagtgcccgaccacgctggcgatcagcgccctgccgcccctgggcaccagcaggtcgatatgtccgcgcgcctccatcagggcccgagcgcccgcccggccgtactggtccacgctggccaccaggtccggtctctggccttggtccgccagggcctggcgcaagacatccacaatcgcttggttggtgcgcttggcggcatggcctcctcgaagaaggacggcattgccggatttgaggcagagggccaccacgtccgtggttacattgggccgggcctcataaaccatagcaaccacgcctaggggtacgcgtacttgctccaagcgtaaaccgttgggcatccggtggccgcgcacgacccgtcctagggggtccggctggtcggccacctgacgcatggcatgggccgaggcggctacgcgctcgcggtcgtagcgcaaacgatccagaagaccttgatccatgcccgaagcgaaggcctcatccatgtcctcttgattggcctgggttatggcatcggctccggcgagcaaggcgtcggccaggacaccgagcaactcccgcctggcctccccgtcggtttgagccaaccccgcttgggcttgagccgcccgatcagccaaagcgcacacgcggtccatgacctcctggtcatgagccaggccggacccgtcgtccccgtaatccgcatgagattccatgacttccgtgggcctccttagcttcgccgcacgcgctacgctccggtttgtctctgattgtatccctgccagcgccccgccttgcctcacccgacctgatccaggccttcgtacaagggaaagtcctgagcgagcgcgtccacttgggctttaaggccctccacgtcagcgtcccgtccagcaaccagggcttgggcgatgatctcggcgacgcgctcgaactgaacagggccgaaaccgcgcgtagccagggcggccgtgccgatgcgcaagcccgaggagaccgatgccggccgtgggtcgaaggggaccgtgtttctgttgactgcgattcccacgcgggccaagaggtcctcggcctccttgccgctgagctcgctggctcgcaagtccaccatgaccaggtggacgtcggtgcctccggtcagcacgctcacgccgcgttcggccaggtctcgcccgttcaggcggtcggcgatgatccgcgcgccctccaaggtccgcgacatccgctctcggaaagccctcgtccccgccaatttgaaggccacagccttggctgcgattacgtgcatgagcggaccgccctgctgacctgggaaaacggctgaatccaagaccttgccataggcgctccgggccagtatgaagccggagcgcggccctcccaaagtcttgtgggccgtggaggagacgacgtccgcccaaggcaccggcgaggggtggaggccagcggccaccagtccggcgaagtgcgccatgtccacccacagcttggcccccacctgatcggccacctgcctcagagcttggaagtcctcgatcctggggtaggcggaccaaccggcgataatcacggagggatgcgtctgcaaggcgcgttcaagcacgatctgcgggtcgatcaggtaggtgtccggattcaccgtgtaggtctcggccttgtagaaacggccggagaagttcatcctggtcccgtgcgtcaggtgcccgccgtggtccagggccaagcccagcactgtgtcgccgggcttggccagcgcctggtataccgcagcgttggcttgggcgcctgaatgaggctgaacattggcgtactcagccccgaagagctcacacgcgcggctgcgcgccagctcctccacctgatccaggaactcgcatcccccgtagtagcgcctaccgggatagccctccgcgtacttgttcgtcagcacgctgccctgggcctgcagcacggccttaggcacgaagttctcggaggcgatcatctcgagccccccgcgctgccgcttcagttcagcctccagcagagcggctatctggggatcggcctgtccgatccccatggtgaacgcctcagtcgcctgctccctactgtctgtcattcctgcgtctccttacatatcgcttacgacgctggtatccagggccgaaacctggcccgcgctgtctgccgaatccatatactgttacttattgcttgcattgattacggcgcgaaattcgcacagtgatcgaaagagccgttctccagtccttgcgcaggtcctaaggctcctctgcacccgaactggctaccgccctaggggcgtaccctcgcgctggaggcgttcggctgtggcgattgtatacaaagcgggagcaaaagaggaggggttgtgagcgaagccacagaaaaaggggccgtaatcacggacgtgcaggagcggccgaagcatttggtgcgcacgttgctgcgctccctgcgtgagtatcggaaggccagttggctcgctccagcatacgtcttcgtcgagagcgtcctggaaatcgtaatcccgacggtcatggccggcctgattgactacggcgtctccgcccgctccatgccgaacatcgccaaattcgggcttattcttgtttgctgttcgctggtctcgctcttctcgggcttcatgtcgggcaagtatgcggccatcgcctcggccggcttcgccaagaacctgcgccatgaccttttcgacaaggtgcagtccttctcatttaccaacatcgaccgcttctccacaggctcgattatcacccgtctgaccacggacgtgaccaacctgcaatacgcttaccagatgatcatccgcgtcggggtgcgtgcgccggtcatggtgatcgtcgcctggttcttctccttccgcatctcccactcgatctcgatgatcttcctggctgccatcccgattctgggcatcgggctcatcggcctgtccgtatgggtccacccgattttcgagcgggtcttccataggtacgaccggctcaacggcgtggtcgaggagaatctgcaaggcatccgcgtggtcaagtcctacaaccgcgaggaccacgaggagcgcaagttcagccgcatctccatggccatctaccgggcttactgcagggccgagcacatcatgagcttcacggtccccctgctcaacttctgcatttacacggccctaatcctgatctcatggctgggcgcccagcaaatcgtcgcctctggcaacaacgcggcgcacggcctgaccaccggcgacctgaccgccctggtcacctataccatgcagatccttatggccatgaacatgatctcgatgatcgtcgtcatggtcatcatctcacaggcttccgcggagcgcatctgccaggtcctcgtggagcgctccaccgtggagaaccccgcccacccggtgatggaggtgcccaacggatcggtggaattcgaccatgtgggcttccgctactccaattcctccgaaaaaccggtcctggacgatgtgagcctgtcgatcacgtccggacagaccatcggcatcgtcggcggcacggggtcagccaagtcgagcttggtccagctgattccccgcttgtacgacgtgacccagggcacgctcaaagtgggcggacacgacgtgcgcgaatacgacctggaggccttgcgtgaccaagtggcgatggtcctgcagaagaacgtcctcttctccggcacaatcgccgagaacttgcgctgggggaacccggacgccagcgacgagcagctgcggcgggtctgcaaactggcccaagcggactccttcatccaggaattccccgataaatacgacacgatgctcgaccaaggcggcacgaacgtctcgggcggccagcgccagcgcctgtgcattgccagggccctgctgaagagaccaaagatcctgatactggacgattccacctccgccgtggacaccaagaccgaccaactcatcagaacggccttgcgcgaggaaatccctcgaacgaccaaaatcatcatcgcccagcggatcgcctcggttgagcaatccgacttaatcgtcgtcttggacggcgggcgcatcctggataggggcacccacgagcagctgctcaagacctgctccgagtaccgttccatctatgaatcgcagaccagcgagcctgggcaggaggtgcgggcatgagccagcaacaagcagataagcgccaggggcgtccggccatgcagaaagccgcaccaggaaccagcaagcgcattttctcctacatcctgcactacaagtggcaggtggccgtcatcgtcgtatgcatcctggtctcggcggcttcccaggccgcctcggccctcttcctccagacgctgatcgaccattacatcctgcctctggtgggtgccgataatcctaactgggctcccctgatccgtatgctaaccctgatggcgtgcctgtacgcggtcggcaccttctgctcctggctgtggtcctggctgatcgtcaaggtggagcagggcactctcagggatatccgcgatcagatgttcgcccaccagcagcatctgcctattcgctatttcgactcccatgagcacggcgacacgatgagccgatacaccaacgacaccgacaccctgcgccaggcgatctcccagtccttcccgcagatgttctcctccgcgatcgcggctctggccgccctggcctctatgctctggctctcagtgcccttcaccctgttcaccttggctttcagcgtgctgctgattgtcatcgtacgcgggatcgtcacccgatcaggcctgtatttcgtcaagcagcaacgggcgatcggccaggtcaacgccttcgtcgaggaggcggttaacggtcagaaagtggtcaaggtcttcaaccatgagcgcaccaccgccgacgacttccaggcccgtaacgaagagctgttcgaggcggccgccgaagcgaacacctatggcaacgtgaccatgcctgtagtgggcaacatgggctacatgctctacgtgatcctggcgatcctaggcggcctggccggtgtgttcggttggggcaatttcggcctgtctggggcgggccccctaactttgggcacgatcatctccctgctgaccctttcgcgctccttcatcaaccccatcggccaggtctccatgcagttcaacatggtcatgatggccctggccggcgcctcccggattttctcactgatggatgagcccgtagaaaccgacgacgggagcgtgcagttggtctcggtggagttgggctctgatgagcgcacgatgacggaagttgattacgagaccggtcattgggcttggaagcgagccgacgacgacgacggaacccgttccctggctgcagccgccaaactcagaggcgatgcccggcaggtggcgatgaaagcgaaagaggtcgcggtcacctcccccgacggacgctataccttgctcaagggagacgtgcgcttcaccgatgtgaccttcggctacgatccagccaagccggtcctgcacgacatcacctggttcgccaagcccggccaaaagatggccctggtgggtgctacaggcgcaggcaagaccacaatcaccaacctgatcaaccgcttctacgacattcaggaagggcagatcctctatgacggcatcgacgtcaagaacatccgcaagcctgacctgcgccgttccctcggcatcgtcctgcaagacgtgaacctcttcaccggcaccgtgctcgacaacatccgctacggccgcttggacgcgacggacgaggaatgcatcgaggccgccaagctgaccaatgcggacgggttcatccgcatgctccccaaaggctaccagaccgtgctggagggcgatggctccggcttgtcccaaggccaacgccagctgatttcaatcgcccgcgccgccgtggctgatccaccggcgatgatcttggacgaggcgacctcctccatcgatacccgtaccgaggaggtcgtccaggagggcatggacgcgctgatgaaaggccgcaccactttcgtgatcgcccacagactctctacagtgcgcaactcggatgtgatcatggtcctggaccacggacgcatcatcgaacgcggcaaccacgaggaattgatcgcgcagcacggcgagtactatcagctctacaccggagctttcgaattggaataaccgttgtgcggttaaccgcatatggttgtgcccgccgggacccacccggcgggcacaaccatatgcggagcccaccagcgacactccgcgctgccgcgcccgacttgaatgggattttgggcagaagcgaacagcttaaacctttcaatcgccactttcgcgttcgcttgtgcccaaaattgctcaacgggttttatgggggttgggttatcggccctgctggtgcgcgtatatcgacgcttgctccgccctgttgctatctaacggccctcatagctccttcttgccgtagatgcgcagggagcaggctatcgagatcaagacagcgaggacagccactaggacaccgagaatgaccgtacgcaggacgctggtggtcaggaaaacggcgatacgggcagcccaatcctgcgggatgcgcgaaatcaggaagcccaaggccactaatccgatcagtgacaggctcatgccctttaagacgctcatgctgttgaaccgatacaggagtggaaggaagatgcagatcaggagcaagaccgtcaataagcagatcccgcagaccgccaggaccggcatatccagggcggtacctgtcagatcgaacacgaccggcatatccagggcggtacctgtgagatcgaacacgaccggcaccagcaggatcccaaccaggtaggccaagaggtcgaaggctgacatgatgtagcgtcccagcacttgccgtgagcgtgagataggaatcattccatcgaagcggatgtctccggattgttcggttaccaagaaggggtacatgctgtacaaagccgtcacacagcctacgctcccgcagatgccgccgaacatcccgtcgacggattccgtggtcttcgcacccgataaccccatcaccagcgccatgatgacaggcagggcgatgatcagcgcaatcccatacactttgccgtaggactccaaccgcctattgtcgagtcggacttgcgcgatgatgccattcataaccgtacctcctgtcgctcgtcttcaggtagttgctcacggattcccttgctgtttccatcggacacccgctcgctggtcaggcgcatgatgtcatcaaattccgggcgttcctggctatagcggcttgcatcgggtccagcgactgcatggcgacccccttccgcagtcaggaaggcttgcgcattttccgccgccaccagcgcgtcaaagccagtggcgaactcgcggacaccgaccgccaaccgccgctgggccgttgtcaggtcgccgggagccccgtggatcaggacgaaggcgtcctcgaactcgtcacgcggaccggtgtagcagagggagccgccgttgatgtaggtgatgaagtcggcgacccgctccaggtcggaggtgatgtgggaggagaagaggaccgagtgctggccgtcggcgatgtagtcggccaggaggtccatcagctcatcccgggccagcacatccagaccggctgtaggctcgtccaggaccaggagcctggcgtcatggctcaaagccacggccagcatgagtttcatctgcatgccgcgggacaaatccttgaccttcttcttgggagcgagcccgaagcgctccaggtactgccggaaagcgtcctcctgccaagtcgggtacaggggcgccatggctttaccacaggtgtccacagtccacaggttcacgaagtaggaggtgtcgaacaccactcccagttgggctttgaccgattcctcatgagcgatgttatccatgcccaggatctcgatggtcccccgatccctcgtgatcatgttgaggatgagtcggatcaacgtggactttccggctccattgggaccgatgagccccatgatgtagcccatggggaggtcaaaggtaacatcgttgaggctgaacgaatgcccctcagcctcatccttggtgcgccggtagtgtttgcctacgtcatttacgcggagggcgtaggcgggttggtttcgcatcctctcgttcatgctttgtcctttctggtgttcgcttcccaagttcagcttcaggaatccaactgcgccatggcctggtccagcaagtcgtgcaagtcgtccccaccgattcccgcggcccgcgcggcttgcgccgcattgtcgaggtccgagcgcacctgcttgaccaaccgttcgtgcatacgttcattgctccggtccaagacgaacgtgcccttgccctggatgttctccaggatgccctcctgggcgagttcgttgtaggcccgggtcacggtcagcaccgagatgcgcaggtccttggccagggagcgcaaggatggcagcgactcccccgcccgcaggctgccgtccaggacggcagagcgaatttggtcctctatctgctgatagatgggttcaccggacacggatgagatgatcagtttcatccaagcccccctccgttaaaagtcggcagacagcagacgcccctgcgtacctggtaagcgacgtactactgttttactgtcatacataactctataacagtagaagcaactgtgcaagtcaactgcataacagttagcggaatcggctccatttggcgaggcgcgaccccagttccgcactccttacaggcaggcgggcgcctgggagaagtcgcgaatagcgccgtcggccacggcttggatgcgcccccagtcagacgccgaggaatcgtcatacacggcccacaccttcatgcctacgctcctcgcggaacgaagggccagcagcaggtcctcgaaaaccgtgcaatccgtaggctccacccccaactgacgggcggcaagccggtagatatcgggctccgccttgccgaccgaacccgcgtcatccacgctgcatgcgcaatcgaagcaatcggccatgccggcgtgttccaaggccacccaccgcaggctgtgaggcaggctggtagccacagccagccgagccccagtggccttgagagcacgcaggtagcctacggcatgaggcttaggcttcacagcagtggcgtagagaatccgagcgtcattttcccactcgtccacaagggcctgcggccgttcgtccaggccgaagcggtcaatggtgtaccgagcgatcgcgtcggtctgcatggaagcgaccgtcgacgcgtaatccgccggcatgccgaggccacggcgctcgaagaatcggcggtcgatctccagccatacacccatcgaatccaaaagagtgccatccaagtcgaaaatggcgcccttgcccttattgcagagcccgcatccgtcagtccgcccagactggcccatgcccacaacctccccgtcaagccgaagtattcgactcataaaaagctagagacggctggcggccaggagctcccgagcatgttgaatcgaagtgcgggactcgctgcccgccaacatgcgggcgatttcctgctcccgatccccgccgtccacctgccgcacctgggtctgaaccccggagtccccttgccctttggcgacgacaaactgtcgatcagcccatgaggccacctgggcaaggtgggtgacgacaatgacttgggaactcgtagccagtcgcgctaaacgtttgccgagttccacggccgccttgcctcccacgccggcatccacttcatcgaagatgaacgtcatccgagcgccgctcgttgcatcctgcgcggtttccttcccgccttggacgttcttggcgtcagccgcgaccagctccatagccagcatgagccgactgagctcgccacccgatgcggaggagcccatcggcaactgctgggacccgggaaaaggagtgaaaaggaaggacacttcgtccatcccatgcgcatccatgcccccatcggaccgaggccgcacacgcacgtccaaggccgcgccccccatagccagagcgccgagctccttacccaccttggatcccagggtgcgaccggcggcagaccgcttagcgctcaaattcctcccagcttcagccgcggcttggagggccgcctgcctctcctcccgtaatgcctgcatctgctcaggcgaagcgtccatatcctctaaatcgaaccgggccttgtcccgccaagcaatcacatcctcgattgatggcccccaacggcctttaagctcttcgaggtcgtggatgcgggcgttgattttatccaagtcaccggcccctccctcactgtcgagctgccgggtcaggttgaagaccagatccgataggtccgcgctaatggaacgcaagcgggccagactgtcctcaaagaggtcgttgacccctgtggattgcagggattgaatggcttgctccaccagactggccacactgggcgcttccacgtccacatccagctgggaggcatccaaggcgctgagagcaccggtgaccccctgggcgatctgcgcgccgtgctcgatcctgtcccgctgctccttcagatctgcgtcctcaccgggccgggggtccaccgagtcgatccgttcaatcgactggcgcaggtagtcggcttgctgaatgaccccggcctgctgttcctgaagcttatccagctttttcgtcaaggtctgcgcacgttcccatgccgcccggtaagcatcgagctgaggctgatctcccgcgtaagcgtccagaaagtcacgctgccgagcgggcgaagccatgcgcatctggtctgactgtccatggatggtcaccaggcgctcgctcaaatccgtcaagagggaacgcggcacggtacgaccgttggccaaagacctggagcgcccctgggccggcaccgaccgagccaggtaaagcaaaccttcctcaggctccagacccgcctcttccgcgaaccccagagcaggcgatccggggcctaggtcgaagataccctgggcccaggctgtctcccgcccaggcgtcacccgggcgttctgggccagcgcaccggaaatcagacctatcgcgttcaagagcatggacttgccagccccggtctcccccgtgatggcggtcatgcccgcggccggcgccaggcgggcgtgacggatgggccccaggtcgcgcacctccaactcgtccagcatcacagtcccttccctgggccattcccggtgctttgagccttgcggctctgctcccgccacccaacgacaggcaagtcgaacttactcaccagacgctgggtgaacggcaccccggacaggcgggccaagcggagcacatcgcgcgaacggcgcacctgcacccgtgaccctcggggcaccatgagctgccggcgtccgtcgcagcatatccacccatccgaaggcgagtcctccagtaaatcgatggagaattcggagctcgggccgatgatcagcgaccgggcgaagagggcgtgcgccgcgattggcaccatttgcaaggattgcgcatccggccacaccaccggacctcccacagagaaggcgtatgctgtggagccggtcggagtagcgactatctcaccatcgcagccgtaggaggacatctccacatcgtccacccgcacgctgacttcaatcatcttgcctcggtcgtagcgctctagggtcatgtcgttcaaggcccagtcttccaaaggcttgtccgctccgggcaaccacaggtccacatgctcgaccatgcgctcatccagcgagtagtcgtgatccgccacacgtttcatggcctcctcgatctgaaaactctcgaattccgccaggaagcccacatggcccaggttgacgcctaagatcggcacaccggaggtcttgacgagttcagccgccctcagaatcgtgccgtccccgcccaggacgatgacgatctcggtgtcctcgtccacccgctggcagggctggccgaaagcaggcgcctcgctgttatcgatgatggagacatcgaagcccgcctggcccagctgccctagggcctcgaccacaatggggccggaacgcacccgctggtgggtcaccacaacggctttccttctgcccatcatccctctccttactattcgctacgccgcccaggcccagccgcctacgcgcccgaagcgagccgctggtcccgaaactcgcccatcgggttcgcctgctcctccagcagataccggggcggccgttgcccgtccaccgcctcagcatccaccaccacgccggtcacaccttgcagctcaggaatctcgaacatggtcccctccaaggtccgctcgatgatcgcgcgcaaacctcgcgctcccaccccggcctggaaggcgatttgggcgatgcgttccagagcaccctcggtgaaggacaaatccactccgtcgtccaggaacatgcgctggtattgcttgaccaacgcattgtccggttgggtcagcacttgccgcagctggtcctggtccaagcgccccaaagtagtgacgacaggcagtctcccgacgaattccggcaggagtccgaaggcttccaagtcgtccgcattcacttgctgaagaatttgctcccggttcagctcctggtctcggctgggcgcggcgaagccggactcccgcaagcctaagcggtcctggatgatatcctccagaccgacgaatgcaccgccgcagatgaaaagaatcccacgcgtgtccagctgaacgctctcctgctcacgctgctttcgggaaccttccaagggcacattggcgaccgttccctcgatgattttcaagagggcctgctgcaccccttcgcctgagacatcgcgtgtgatggacgtgttctgccctgacttgcgagctatcttgtctatctcgtcgatgtagatgatgccctgctgagcgcgctccacatcgccgtcggcagcctgaatcaaacgttggagcaccgtctccacgtcatcgcccacataaccggcctcggtcaacgtagtcgcatcggtgatgacgaacggcacattcatcatccgcgccaaggaacgagccaggtaggtcttaccgaccccagttggccccagaagcagaatattggatttgtccacctccacctgctccagcgcattgctccggtccgccttgctgacgccgatgtccccagcctccgttccgcctgtttcaatcgcggcggcggacaagctcatactcgccaaggcccgatcccggtccatccgtacccgtttatagtggttgtagaccgccacggacaacgtgcgtttagctgcctcctgacctaccacataacggttcaagtaggcgaaaatgctggaaggaaccggcaactcgtgctgctcggaccgctggcctttggcctgatcctcagacagaatctgcacgcatagggccacgcactcatcgcaaatggcggaggaaggccccttgatcaggcgtcccacctgcttttcgctcttaccgcagaaatcgcagcggaacagcccctcgttgtaactgacgacgcgccccatagctctccttcctgccatccagcacatccatactacgcgacgtctcccacccacgaccaggcctcagtgccatgtggtcgaatgcgcctgcctatccaccggggacaaggaagcccccggaccgggtcctttccccggcggggggcttgccagccgctcaacgcggcttacttgcggtgctccagcacctcgtcaaccatgccgtattccttggctgcctgagcagtcagaatcgtgtcgacctcgatgtccttgcggatcttctcgatatcctggccagtgtgcttggccagggtttcctccagccattcacgcatgcgcagcatctcacgagcctgaatctcgatctccgtggccttgccgaagtcctgctccatcgcaggctggtggatgagcacgcgagcgttcggcaggatcagccgcttgccctcggtccccgccgccagcaggaccgctgccgctgaggcagcctgccctaggcaaacggtctgcacgtcgggcttgatgtactgcatggtgtcgtaaatggcggtcatggccgtcatcgacccaccaggcgaattgacgtaaataatcacgtccctgttggggtcctggctctccagaaccaggagctgggccatgatgtcatcagccgaggtgtcgtccacctgcacgcccatgaagatgattcggtcgtcgaacaggcgggtgtaagggtcctgtcgtttgtacccgtagggggtcttctcctcgaactgaggcaggacataccggctctgggggctcagggcggcccttccggaaggtcccgccaagcgctgggcccgggctacgaatcgtgcttcttcagatgccatgtctcactccccccttgtcggacctcatcgtgccatgcgtggtcacgattttgtcgacaaagccatattccagcgcctcttgggcgttgaaccagtggtcgtattcgttatcgcggtaaatctcctcgaccgtatgcccggtctggtcggcggtcaactgcgagagggtcttcttcatgtccatgatcagctcggcgttaatgcgcacatcggtggccgtgccgcccaccccgccggaaggctggtgcatcagcacgcgagcgtgggaggtgatgaagcgcttgcccttggtgcctgaggacagcaggaactgtcccatcgaagcggccatgccgaccgccacagtggccacgtcgggctcgattagctgcatggtgtcgtaaatcgccattccagcagtgatggaaccgcctggggagttgatgtagagccagatgtctttcttgggatcctcggccgcaagcatcagcatctgagcgcaaatcacgtttgcgttagcgtccttgacctcgtcgcccagccagatgatgcggtctttcagcaggcggttgaaaatggggtcggtcggcgatggcgcctccccctcctccatgacgggcagagttgcaagagtattgctcaccgtgtctcctttgatgtgcattccatgtttcgagcctaccgccttgcggcgacccgcgccggacgttgcgcttcttgcgcaaaagccgcgcctggcgcaaaaccgaggctacctcggtccacgctaggcgcggccctcacacactcaccgtccgcgaacggccaagctcactcctggctatcgccttcgttggaatcctcgtggctgatctggtcggccacagcggcagccgcggaagcggcctgcacgctctcgtcctcctcggcctcagcctgagcggcgtcgtcctcatcctcgcccaggaagcgcgacaggtccagggccttgccgtcggaatccttgaaggtgacggccctcataccggcaagcattcccttggaacgaccgacttcctgcacggccgaacccagctgcccgttctgtacgatcgcattgatgaaggcggagggatccatgccgtactgctgggcgatggaggccaggaagttggtcacatccacctgagtgaccgaaacctgaagcttttcagccagcgcatccaagaccatctggtcgcgcagctccttctccacgttcttctcggcttcgtccttctcctccttggaggcggaatcggcgcccttgccaccattcttgagctgatcggcgaccatggactccttgatgcccttgggcaccggaatatccagaccgtcctccagcttggcgatgaaggcatcacgggcatcggtggcctgacggccttcggcatcggtctcgcactgcttgcgcacgtccgccttgagctcgtccagggtgtcgaactcggaggcttccttggcgaagtcatcgtccagctcaggcagctcctcggccttgaccgagttgaccttgaccttgatttgggccttctcgccttggtggtcgcccgcttccagggtgccgtcgaaggtggtttcctcgccggcggacaggccgtccaaagcctcatccagaccgtccagcatggtgttggaaccaagctcataggagacgccctgctgggagtccacggactcgccgtcgatcaccgcttccaggtcgatcgaagcgtagtcgcccttctgagccgggcggtccaccgagacgagcgtgccgaagcgcttgcgcagattgtccaggcgcttgtccacgtcttcatcggtgacctcaggcttggctacctcgatctccatgccctccaggtcgggcaggtcgaactggggacgaatctccacctcagcggtgaacttgagcttggtgtcgtccttggcggactcaggcacgtccttcacgtcgatttgcggctggtccatggcgtgcatctgcttctcggacaaggccttggagtaaagctcgggcacgccatggttgatggcctcgccgacgacggccgcgaaaccgatcctctggtcgatgatcgggccgggcacatgccccttgcggaagccaggcacgttgacctgcttgccgatctccttgcgggccgcgtccaggtaaggatcgaactcatccctgtcgacggtgatggtgagcctgaccttggtaggctcaagattcctgacgctgattttcacgctgcgctccaattcatcacgtacgtatcacaaccggttgatctgccgatgtctgccagttccctgccaattcagcaaccgttacataatagcgctacttacggactcgctgaccagaccgacctgccaggggcgcgcgccctcaccggccagaaacgccgccacatccccgccgacgagctcatccctccagcataaatcccgcaggtactggggcttgatgatcacgtccgccggggttcgcacgtcttgggcaatggtcgctacagccttgcgagcggcgcataggcgggcgtagcgcgccggatggcgctgccagaccttcattgaacgcggcgccttgccctcctccccgttgccgtgtcggggcttgggcggtcggggaagttcgtcctccccctcttgcagggcttgcaggatggcgcgcctccagaccgagggctttactgagcgctgaatcggggcgtatcgttcaaacattttgtcttgctcgccaccggtgcgcatgcgcacccgctcattcaaggatcgaatggcgcggaactggcgaccattgcgcggcttcatacgcgcggcctcgatgatcgcggcatccgacagcagcagggagggcgatatgtccaattctcgcgccagccggtcacgctcggtccacagggccctcgcaacggccagtccgcggcgatccttgcgtaggacattgatatgggatatgtgccgccagggttgctcgccgcggtccttgcgcttggcgccgtcaaccaggagccaggcgaactcctcttgcgcccactcatccttgccctgagccttcaactcacgactcatggcctggtccagctctatcaggagctccacatccagggcggcgtagttacgccaatcgcgtggcaacggcctgtacgaccagtcggcggcggagtgctctttggccagggtgaggcccaggtaatgctccgtgaccgctgccaggctcacatgcttgaggcccagcatccgagccgccagctcggtgtcgaacagggcacgaggagccatgccgatgtccacgaaaccaggcaggtcctgtcggctgtcgtggatgatccactcagcgtcgcccacggcctgattgaagtcctgccaggagccgcctgccttctccaccgccacagggtcgaccaaggctatgcctgcgccctcgcgtttgaattggaccaggtaatcctcctggctgtaccgaaaccctgaagcccgttcggcatcagccgccaaagggccctcagcctgcgagtattcctcgcacatcaagcggaaggcgtccaagccgtctatgacatcaggtacaccctcccggggttctggcagcagatgtgattctcgctctagggccaacgtcttcttacgcctctctggggcctatcggttacggtgtacacagcttagcgcgaggcctgaaagtgctttcagtagacgacgaaactgtggtcctccaactgcttcctgaccctgtcctgcaaagcgtgcgagggtcccttcttctcctccagggggtaggggatgcgcatctcgtgccacttgggccgacccagctggtggaagggcagcacgtcgatatgctcgatagcgccacggaattgctcgcagaccttggccacattctcaacgttctcgacggaatccgtcagaccgggcacaaggacgaagcggacccaaatcttggagcctgcagcttccaagcgcttgccgaattcaatcgtgggcgccagggtgcctccggtgacctctttgtaagtcttctcatcgccggacttgacatccaggaggcacaggtcgatgtccttgatcatctcgtcggtgtagttgcggttcaggaagccggaggtgtccaagcaggtgtggacgcccatctccttggccgcgcgaaagacgcgtgagacgaaagccgcctgcatcatcgattcgccgccggagaaggtgatgccaccgcctgtagccttgaagaggtcctcgtaacgggcgaccttgtcgatcatcgcttgcaggtagaccggttggccgtcgcgcatcttccaagtatcggggttctggcagtactggcagcgcagggggcagcccgacatgaagacggtcatgcgggtgcccggaccgtcgactgaagtgttgatgtcccaggagtgcacgaagcctatgtcaccggtgcgcagggcgtcgatcctgtcccttctgtccaggccgatcggcgattcaaagcccgagagaccacccattaaggtttgggtttggtagaccttcgactctttaagcatgtgcggcttcgtcgtgcggaattgcgtgccttgagtcatcaactgcctccctgcgtccttgcgtccggctgctaccgggaaccactatatcaagattggaaccaacgataggtcgggtacggcgataaaagaggggcggagccacgggccccgccccttactgcttacttgagcttcctgctcaatgccagcgccaggctagctggcatcaggccggatgtcagtcgaccacagctccctggtggaaggtgcgggagatgacgtccagctgctgctcacgggtcagcttgacgaagttgactgcgtagccggagacgcgcacggtcaggtgcgggtacttttcaggatgctccacggcgtcctccagctgctccttgcgaagcacgttgatgttcgcgtggtagaggccgtgaccgttaccggaatccaggatgccgaccaggttcttaatgcgctcatcctcgtcgcggcccaggccgtcaggggtgatcgtgttggtcagcgagatgccgtccagcgcgtcatcgtaatcaatcttaccgaccgagaacatcgagggcagcatgccgtgggaatccataccgttctcagggttcgcgccgggtgcgtacggcgtgcccttcttgtgcccggaggggaaggagccggtgttgtggccatactctacgttggaggtaatggtcagaatcgactgagtggggacagcgccacggtagaccgggagcttcttgatctggcccatgacggtggctaccgtccacttggccaggtcatcggcgcgatcatcgtcgttgccgtaaatcgggaactcgccgacggtcttgtagttgacgaccaaatcgtcgtcagcgccctcgacgtactccggggtgcccttggcgtccttgttataaatcgggtagaccttggcgtagcggatggcggacagggagtccgcggcgatcgacagaccggacataccgcaaccgagggtgcggtacacttccttgtcgtgcagagccatctcgatggactcgtaggcgtacttatcgtgcatgtagtggatgatgttgagggcctcgacgtaggtctcggacagccactcaagagccttctcgtagttgtccttgaccttctggaagtccagagtcccgtcggcttcgggcgtgatcgggtcgatgatgcccttgtcgatcacctgcatgccggtcatctcatcgcggccgccgttgattgcgtagagcaaagccttggcagagttcacacgagcgccgaagaactgcatttgcttgccgacacgcatcggtgagacgcagcaagcgatggccgcatcgtcaccccagtgggcgcggatgtccttgtcggactcgtactgaatggccgaggtatcgatggagatacgcgcgcagaagcgcttatagccctcaggcagcttcggatcccaaaagatcgtgatgttcggttcaggcccgggccccaggtgatccatggtcagtgttgcgagcagacggaaggaggtcttggtgaccagtggacggccgtcgtcggagaagccggcgtcggaccaggtggcccagtaaggatcaccggagaaaatctgatcgtaatcgcgtgtgcgcaggaagcgaacgatgcgcagcttcatcacgatgttatcgatgatctcctgggcatcggtctcgtcgatcaggccagcggccaggtcacgctcgaagtagatgtcgaagaaggcggaaagacgaccaatggacatagcggcgccgtcctggctcttcacggaggccaggtagcccatgtaggtccactgcacggcttccttggcggtctgcgcggggcgggacaggtccaggccatactcctgacccaggttcagcagctgcttcagggccttaatctgctcggagtgctcctcgcggaagcgaatccaatgctcaatctcgtcctcggtgaagtcgttgcggtaaggaatcgaatccttgtcggcctgcttgcgggcaatcagctcgttgacgccgtagagagcgacgcggcggtaatcaccgatgatgcggccacggccgtatgcgtccggtagaccggtgagaatcttgttgtggcgagctaccttgatgcggcgggtatagacatcgaacacgccatcgttgtgggtcttgcggtagcgggtgaagatcttcttgacctcagggtcaggctccttaccggcttccttgatggcctgctcaaccatacgccagccaccgttcggcatcatggcgcgcttggtcggtacgtcagtctgcagaccgacgatgacgttgtcctgggtatcctcggcggacttgccatcgatgtagccggcggggaaagcgtcaatgccggccggagtgtgagtgtccacgtcgtagacgcgctgcttgcgctccacggcgaggaagttgtcgtccaagtacttccacagagccttggttttctcggtggcaggcttcaggaaggactcatcgccggtgtatggcgtgtagttctcctggatgaagtcacggacgtcaatgtccttccgccagtcatcgcccttgaagcccttccaagccttcgcttgaagttcctcgggagagacggccgtcttcgtatcaactgctgtcattgcaactccttgttgacgtgtcagcgcgcgtcttcacgctgctgccttcagctctcattatatgaggcggcgcctttgaatgaggcccataatgccgtgaggtttatcacactagagggcaaattccgtattttttattgacaacctcaccttattgccctttgctgccccgttcgtcgctccagtcatttcgccagcgccggtcctcctcctcccagcgttcattgcgctcttgcgctattttccaagcttccagagccgcttcccgcgtcgggtaaggacccatcctccgctcccccggtgataccttgccaagctcggcctgaccggttgccgtattgaaaaaccattccttttgctcactcaccatgcgcacttcctttccctggcactacgccattgagccccggacgaacttcacttcgcggccatcccctgacggggtccacgcgctatcctctggtctcattcagcgaaagcattggtgaccggaagcctgcgatcacggccgaaggccagggccgtcagcttgggccccagcgggtactggcgacgtttccactcggcccggtccaccaaacgcatgacagtgtcgaccgtcttcgggtcgaacccgtcggccagcaggtcggcgcggccatgggccttctcaatgtaggcctccagcaccttgtctaagagcccgtaatcaggcaaggaatcagagtccttttgaccctcgcgcagctcggccgagggggccttggtgatcgaagcgaccggaatcggttcaggttcgccagccgccttggcctgggcgttccgccagcgcgacaactgccaaacccgcgtcttcaacaaatccttgatgggcgcgtaaccgccgacggcatctccatagatggtggaatagccgcaggccagctcggacttgttgccggtggcaagcgccagcagccccttcgcgttggagtaggccatcacgatgacgccacggatgcgtgcctgaaggttctcggccgctacgcccgtcaagttcaactgatcctgaaacgcggagaagagggtttctatggcctgtacctcgtagtgggcccccagccgctcggccaagtcggccgcgtcatccttggagccgtcggaggaatacctgctgggcattgaaatgccccaaatgttcgagcccccgcatgcgtccgcggcgatggtggccacgagggccgaatcaatcccgcctgacaagcccaggcaaaccccagtgaaatggttcttggccatataatccctgagccccagcacacaggcccggtagacttcctcgtcgccgtccatgtcgggggtcagctgggagcccacttgcgcgctctcccccgccgcgggtagggtccagtagcacaggtcctcgcggaactggggcgaatgctccagcagccggccgtcctggtcaatcacgaaggatccgccgtcgaagataagatcgtcctggccgcccacctggttgacgtatgccacgggggcggcgacctcccgggcccggcgttcggccagctcgcgacgtacatgccccttgccctcctcgtagggcgagccgttgatggtgagcaagaggtcaaggtttcggcccgcgagagcctgaattggccccccgtcctgccagatgtcctcgcagatggccacgccgatccgttgcccgtctatggtcagcacgaccgagcgctggccaggcgagaagatgcgaaactcatcgaagaccccgtaattaggcaggaagtgcttgtcatagcccgcccagaccacgccatcgtggagcaccaccatccggttacgcggtagatccttctcgtggtccgtgcccacggtgcctactacgatatagaggtcccccagcccctgttcgctgagctgtcctgctagctcgttggccttgtcccaggccgcgcgtcggaatgtggcgcgcagcgccagatcctcgatcggatacccggtcagcgtcatctcgggaaagaccacaagccgcgcctcatcccgcgccgcccgccgtgcgtactccaggaccttggccgcgttaccgtccaggtcacccacgcacgtatctatctgcgccaaagccatcttcaggctccgcttgcttccggcgaccccgtattccacccgttcgaattcatccactcgtgtcatactcccagcctaccttctgggctacctgtcaagccttcctccggtacctctctgccgtgacggccaggcagggaggatcgccagcggccccatgccggcaaaccgacacctcgctctacgcttgcggcaagcggaaggaatgcgcatgaaacgacgcatcgaccaaaacggggctcccgcattctcgtccttgcacattcccatggacggcggacgcttggagcggacttggaaggcttgccccgcccggccctcagcgaactcggcattgatgcattcgtgggaatagggcgtcgcgaagcgtcgagaacctggtaacgcaggacggcggatgcgagaaaacccgacctcttgcgctggacgcaagagaggccgggtttttcgctgtcagccccaggtttacttagaagcggccttggcggagtccacggcttcggcggcgcggcgaaccttgatggaggccaagagaccgaccaggaggaggatgcaggcgaaggtcatggccagctgcccgccctcgatgaaccctgaggtcagggcgctggtgacctggggtcccagggagcccaattcgccgtgggtgccctgagcgcgcatgcctgaaatcatgttgccggcggaggatttaacagcggcgaccaagccatcacgggcgctggagggcaggccgggaatggaggcgagcttgcctggggtggtgaatccgaccgcaaccgacagcgccgtgcccgagacggcggcgcccagggccgtacccaattggcggatagtggactgggtggccgagccttcaccggattgggcgatggggacgccggagagaaccagactggtcagctgggcggaggcgaagcccaggcctagcccgtagatgaccagcccgaccataagcagccatatgggggtggagccgcccatcgtggcgatggcagcgatgactcccaccatctccaggaccaacccgagctggacggtgccgcccgcgcccagttttgcggaaacgaagcgggccatgccgccggagacgatggagcccagggccaggaccgcgatgataccgcccgtttgaagggtgttgagggagcgggcgttgatcaggtagagcggcagggtgaagatgacgacgaactcaccggcgttgatgatggcggcggtgaaattgccccaaccgaaggtggcgatcttaaagagggtcacatcaagcatgaccaggcggccaccgctcttgcgcctgagctcatgcacggcgaaccaggccaggagcgcgagaccgagaaccaggcaaacagggataatcgaaatcggcgcggactgcgaccaggtgatcgggccgacagacagggacttggccggcctgagccaaccgtacgtctcgccctcaatcaggccgaagatcacgaatgccgagccgaacgcggacaggaggatgccgccgacatcggacagcaggcccaggctggatccttcgccgcgaccctgtcccttggactctggcacgaaggggatggagaagacgaagacgatagcgcccaggggcaagttgaccaggaaaatccaacgccaaccgatggtctgggtgaacaggcctcccataagaggtccgatggcggctgctgatgacatgaccgcgccccagacgccgaaggccgtggcccggtatttgccacggaaattggctgacacggaagacaaggtggaaggcatgaccagggcgccgccgatgccttggaccacgcgggccaggagcaggacggtgccggtctgggaggaggccgcgagcagggagccgcccacgaagaccacggtgcctacctgcaggagacgcttgcggccgtacatatcgcccaatcgacccgaaggcaggagcagggcggccaggacgatcgagtaaagggccgtgatccactgggcatcggtcaggtcgatatggatcgcggagatgatggcggggatggagacgttcacgatggacgaatccaagacgatcatcgccaggcccagagcgagcacccacagggctttccacggcggcttaggctccccttgccgcaccgactgacttgcctgcgctggcttactgacctcagcagccgcttgcatctgggcttgttccattttgtgcatccctttcgcaccgagcgcatctcccctggccgcagcgtgggaccgttcgcagcgaggggatgttttgcgacacattgtcgctaacaggctcgacaataccccttccatccgcttccaggcaaatcaacgctcaccgaacccgccgacccggggacgaggagcgcctccataggggggtcgtcctaaaatcgccttagatgccgcaagtgggccggacccgaggaagggagcgctatgcccaagatcaaggaagccagcctgggcgagcaccgccaacgcctgcaagggctgatcctggatgcagctgagtccctcctcaagtccggcggacggcaggccctgaccatgggcgcagtcagcgagcgcgccggcatagcccgcaactccctttaccgctacgcctccaacgcggaccaactggccgacatggtcctggtgcgccgcctaccctcgtgggccgaggctttgaaccaggccctggaggggcgggagcgcccggatggtgtgatcctggcctgggccgaggccaacttgcgccaggccgtcgctcacgggcacagctggctgatggacctgttcggtgcagtggacgacgagagcctgcgcaggagcttcctgtacgcttccagcgaaccggggcgagacgacatcgcctccgacacggaagccggccgggacgatccccgccaagccatgatccgtttttaccatttggtcaacgatcccctggtcgaagcctggcgcgagctcgtgccggatcgtgcccagaccggcgtggagctcacgcgaggcttggtgcaatccggcatgaggctaattgatgcccaggagagtgcgcagggcaccccgccgaaccggcccgcggaccctcagggcgggcggggcgaaagccaggataacgggcgcatagtggccgacgtgttggcctcggtcagcgcggtcaccaggaccttggccgatcctggcgctggaacgagcgggaatgcgcccggccttgaacctgttgaccaactatcagcggccgatggccctgctgcgggtaggagcgaaaaggaaggcgggaccgcatcatgcgactcataggcaatatcatctggctcatacttggcggcctggcgctggcggcgggatgggccctcgtcggcgttctcctgtgcctgaccgtggtcggcatcccgctgggtgtccaggccttcaagatggccaagctgaccttgtcgcccttcggcaagaccgtgacctacggaggcggtctgggctccatcctggctaacgtcatctgggtgctgctggtcggctggtggatggctgtcggctacgtggtcgccggccttgcgaatatagtcacgatcatcggcataccttttggcatccagtcgatcaaaatggcccaattggctctgatgcctttcgggtcgcgggtatccaagcgcctgtactgagcggcccgtcctcatcaaacccaagcgctgtctgcgggtcgcaaggcagtgggagaataaagaccatgagcactatcatcatgcatacatccgcaggcgacatccgcctggacctcttcgacgacaaagccccccagaccgtggagaacttcctgggcctggcctccggctccaaggagtggaaggatccaatcaccggcgaaacccggcaggaccccttctacaacggcctgaccttccaccggatcatcaaggacttcatgattcagggcggttgccccttgggcaccggcaccggcggccccggctacgaattcgacgacgaaatcgacccctcgctgaacttcgctgagccttataagctggctatggctaacgccggcctgcgccgcgatccgcgcaccggccgcgcccacggcaccaacggctcccagttcttcatcaccagcgtgcccaccccttggctggacggccatcacacgatcttcggacaagttgcggatgagccctccaaaaaggtggtggatgccctggaccagaccgcaacggacggctctgaccgcccgctggaaccggtcatgatcgaaacgatcgaaatcctctagagaccgcgacgcttgactacgctcgggcggggcggcagcaagttcccccgcggcacccgttcctacacgatgtcccgcatccgcggcaaggacacttcgattgagcgcatggtgcgctcgtatttgttcgcgcaggggctgcgctttcgcaagaacgataagcgctacccgggtcacccggacgtggtccttcccaaatggcgggccatggtcttcgtcaatggttgcttctggcacctgtacgaaggctgcgagaattattccttacccaagtcgcgcgtggagtactgggcggcgaagctcctgcgcaaccgggaacgtgaccaagaacagcgagcggccttagccaagcaaggttggcggattttcaccatctgggagtgcgagttgaaaccggaccggcgccaagccagcctggaggctctctacaaggccatcaccgggacgggccccgaagaagaagaagacggcggcccaaagaagcccactcagacagacaaggggtcagtatgagtgcattaaatggcatggggacgcaggccagcgagcgtggcctgcgggtcaaagtggctattctgggggccggacgcatcgcccaacatatggctgatacgttgacgcgaatggcgcaggacaagcgctatcaagggctggtggagccgtgggctgtagcctcacgctccgaagagagggccgaggccttcgccaaagagcacggcatacccaaggcctacgggtcctaccaggggctcctggacgacccggacgtggatttggtctacatcgccacgccgcactcccttcacgccgaacaagcgcatgcctgcctccaggcgggtcagaacatcctagtcgagaagtccttcaccgccaacgcggcgcaagccggacccgtattggatgaagcccgcgagctgggactgctgtgcactgaggccatttggacgcgctacatgccttcgcgcaagatcgtggacaacatcatcgaatcgggcgcgattggacaagtcaaagccgcatcggccaacctgtgctacccgaccacccataaacccaggatgaccgacccggccttggcagggggcgccctactggacgtgggcgtctacccgctcaacttcctggatatggtcttcggccctaagcccctcgaccgcgtggagtcaacggctctgatgcatcccaccggggtagacgagcacaacgccaccacgttgctctaccgcgatgggacgatggggctggcggcctcctccatgaccatggcctccgaccgctcaggcgcgatctggggcactgagggctatctggtttgtcggaacatcaataacatcgagggcatagacgtatacgacgcagaccaccagctggtcgctcaccggtccgtgccagcccagctgaccggctacgagtacgaagtcgccgcagccgcgcgagcgattctggacggggctagcgagtgcccgcagatgccccatgccgacaccctgcggatgatggagctcatggatcgaatccgtggaatctgggggatgtccttcccctttgagcgcccttcccgttgaagttgatccgacactgacagtcgcgccggggttacagacaggtacgaggtaaggtaaactcggggactcattcatcgaatggcacgcactcgccgaggggaggcggtgctggaacggttccaggaaccacggtgccgcttagcgcgaggaaccggccacacatcgggggaggaccatcatagctatggccaagcagcagcaataccacatgatcagcgtctatatcgccagcatctacaggcaatccaaggctgaatacaagaagaagatcgtcaatcccagctgcacaggcacccagagcgacctgctcatgttcctctatgaccacctcggcctctgccagcggcaaatcgctggattcatgggcgtggacccctccctgctggcccgggacgtgaaggccctggaggagcaggggctggtctcgtgccaggccaacccagcggaccgccgcgccaaagtggtgacgctgacccggcagggcgtcaagcaatccaaagagcaaattcaggcgattaacgcctggtgggcgcgcttcttccagcaggagccgggcatggacccccagtccctctaccagggtctggcgtcggtcagccaaaggctcctggccgaaacccgttaatcctcagccacccaaggttgggtgggttccctccacgcgaagtcggataggccccggacgcgagtggccggggacgtctagtccgaccccttagcgccgtcgcttccctggtgatcctggccggcgcccttggagcccgtgtcagcgttgaggatggcccggatccgttccaggcgggggcccagttcccgctcgtagcctcggtcgttgggctgatagtaaacgcgaccagccagctcgtccggcatgtattgctggggggccaccgcgcccggccaatcatgggcgtagcgatagccctccttgttgccccactgcttcatcagcttggtcggtgcattacgcaggtggagggggacttggccgatacgccctgcatccacgtccgctagcgcctggtcgatggccatgtacgaggcgttggacttaggggccgtggctaccgcgatgaccgcttcggacaggatgatcctggcctcgggcatgcccaccatcgccacagcctgggcggcggccacggtggtctggagaatctgcggggcggccatgcccacttcctcggcggcggcgatcatgatccgccgtgcgatgaagcgggggtcctcccccgcccgaatcatcctggccaggtagtgcagggcggcgtccggatccgagcctcgcatggacttgatgaaagccgaagcaacatcgtagtgatcgtcaccctgtttgtcgtacctgaccgccgccacgtccatcaccgaagagacgacgctctcgctgatgacaggcttgcgtgcgcctttcttacgcggtttgtcgccagtgagagccccggcggccgcctccaggaccgtcagtgccttgcgtgcgtcgccgccagccagggagacgatgcgctcccgcgcgccccgatcgactctgacttcgcctttaaggccgcgctcgtctgcgacggcccggtcaatcaggtcgcctatgtcgaccggctccagggcctccagtttgacaacgacggagcgggagaggaggggcgagataacagagaatgagggattttcggtggtggcggccaccagggtcacgtctcggttctccacggcaggcaagagggcgtcctgctgggacttggagaagcgatggacttcatccacgaacagtaccgtctcctggctgctggaaaccagacgctcgcgagcctcggttaacagggcccgcagctccttgacaccggatgtgaccgcggacagctcccggaaagctcgcccggactgtcgggccacgatgtaagccagggtggttttgcctacccccggagggccgaagaggatgaccgaagccggcgcggtcaggcgctgctgggcggacgcccctggcctggccaggcgttccaacggggtgccgggcgctatggccttgtcctgacctacgacctcttccagcgtccgcggccgcatccgcaccgcaaggggcagggtgtgctcgtcgggcgcttcggcagcgctgaacaaatcgtctaccatgattatcgccagcctccctccgaggaaccaacaccagtctaaacgccccgtacgcccagtgccggtgcgcacaagtcgtcaagcgctcacatctcgagcaagtcctcgatgggacctacctggtaatcgatgaagaccgcctgcccttcagcctgggtggcgtcaaggtccactaccccggctatgccccagtcatgatcgccctccacatcatcgaagacctgacggaccttccagacgtgttcggattgctccttggactcttccagggtgaggaaatcggccgagcgcgcctgctcgtcgatattgattgcctcgtgcgcctcgtacaggtcatccaaggcgtcctgccaagcgcgtaagccgtaaccccaatccgcgtccaaccgggccaactcctgggggtggtcgaaggcgacgagctcggtccggtggaacatcgcgttacgcaccaggacccgcagggcccggcggtcctgaaccacctgcccctccccctggggcggcgccgcgttcaagtcggcggttggcccaaccgcgctctgcccggccgcctcccattcgtccaccagggaggagtcgaccgaacgcaccaccagcccgagccaggcgatcacgtcgtccaggcgctcgtccaacatctcgtcgggcacggtacggctcagagcgcggtatgcatccgacaaatagcgcagaagggtcccctcggagcgcgaaatgccgtagcgggctatgtaggagttgaagtcggaggcggtctccagcatgtcgcgcaaaactgacttagggctcagttcgaagtcgttggcccagggcacatcgcgccgatagcggtcgaaggcctgccctagcagctcttccaagggtttggggtaggtgacctcctggagcttgtccacgcggtcctcgtagtccatgccctcggccttcatctcctgcatcgccgcgtcgcgcgcctgccgctgctgggcacgcagaacctggcgggggtcctccagggtggcctcgaccatcgagatcaggtccatgtcgtagtcaggcgaatccgggtccagcaactccagggctgccaagaggaagggcgagagtggctggtccagagcgaaatcctcaggcaggtcgacggtcgtgtcgtagtcgggccgcccatcccgaccggtcaggacctcgatcacgccggaatcctccaaagtttggaaaatctcatcggccctggcgcgcaggtcctccttctccctgggggtctggagggaatcgtcgattacctggtccacgcgagcgcgcgcgtcgccgccttgggccacctcgttcaggaccatcgaatgggtgatcttcaaccgagccttcaaggtctcaggctgggaggaaatcaggtggtcgaaggtggtttcgctccaggcgacgaaaccctccggcgctttcttgcgcttgatcttcttgagcttcttcggatcgtctcccgccttggccagggcccgtgcgttctcgatctcatactcgggcgcctcggccacgaccaagccctgggtgtcgaagcccatccgtccggcccgcccggctatttggtggaattcgcgtgagcgcagacggcgcatccggctgccgtcgtacttggtcagggcggtcaaaagcacggtgtggataggcacgttgatgcccacacctagggtgtcggtgccgcagatgaccggcagcaacccggcctgggccaactgctcgaccaggcgccggtaccgtggcagcattcccgcatggtggacgcccaccccggtgcgcaagaggcgggagaggattttcccgaagccggtcgtgaatttggtgccggctatggcatccttgatcctctcacggtcctgcttgctggacaccccggagctggagagggcttgcgcggtttccagggccgcatcctgggagaagtgaacgatataaatcggcgtgtcccgctgtgtgatcagaccgtcgacggtggtggctggaggcgtgtccacatagcggtaggacaggggcacgggccggggcgcatcggcgatcacgtccacctcggtcccggtgcgctcgcgtagggaatccgcgatcgcgctcacatcgcccagggtggcggacatgagcaggaactgcgtatcgggaagcgtcagcaggggcacctgccaagcccagccccgctctgggtcgccgtaaaagtggaattcatccattgccacgcagcccacgtccgccgaccggccctcgcgcagggcctggttggccaggatctccgctgtgcagcatatgaccggagcgtccgcgttgatgcggctgtcgccggtgatcatgccgacgttgtcgcggcctaaatcgcgtaccaggtcgaagaacttctccgataccagggctttgatgggcgcggtgtaataggaacggcggccggtgcacagggcgatgaagtgcatggccagcgccaccatcgactttcctgatccggtaggcgtgttcagaatgacgtgatcgccggccaggaggtccatgaccgcctcctcctgatgcggccaaggctctatccccttggcccggacccagtcgaagaagcgctcgtagaggtcgtcctcgctcaggttcctggcctcacctgaggcagggaccagggtcgccaaggcgccaggcgacgtcaaatcctctcccgctggacctgatgggggctgagagggggaggcagcggatgggaaagaccgggaaacagacataggctcaagtctagccagagccccgggcagaccctgctggagcgcgaacgcgcccaggaacgcgagcttgagcgcgaacgtcgccgcgcctcgaggcgttaaaaaaacacgtggttatgaaaaccggggcaggcggttcgacgccctctccatcagtggatatcgtttctttgatcctggacggcctaggtcatcaagggccatctattcgtcttgtcccaatccggagaatcgtttgaagaagacgctgagcttgtcgatgacatgctgtttcttctctccaaggcctcccctggcgacgaatcgtgagatgggcggaaggatggccgtaatggacgtgccgcttgtctgcaaggtgccgttacggaaagactccttgatgaactgcttcgtcggttcagccttgaggtgctcttcatcaatgatggactgaagctcctcctgacgtctgcggttgaggaaggttcgccactgctcatccaccgtcccattcatggataccgaaccgacaaaggcgtcgatcagatccttcttgttgcgcagcgaagggctggctgagacggccttgttgatctcggttcgtatctccttgtcctcgccgttgccatgcttctgccggtatttgtccaccagcatgaggatgtagtcgacgttcacctcggtctgcttgaccagctcgatttcgaaggtcagatcatcgttgatgttctctttgtcggccttttctgctgaccggaaagtcgagtatagatccaggtagacgctccggtaatcctggctctcccgttcggacaggatctcctgaccctcgaagtcatcgaaactggtgaggatgttctgcaacctgaggatgctgccgaagagcccaacgaagttcttctgctcctgttcgctccctatccgctgccctatcggataggaaccgagcagctcctggaccttttgtttgtattcctcgtagtagtccttgaagggcttgagcagcacgatgccttgggcgtccttgttgccgaagagttccaaagcctcatcggtttccttctcaaggtttcggaaagagacgatattgccgtatgtctttacggagttaagaattcggttggtcctggagaaagcctggatcagtccgtgcatcttcaggttcttgtcgacgaagagcgtgttcaaggtggtcgcatcgaagccggtgaggaacatgttgaccacgatgaccatgtcgatctcgcggttcttcagccgcatggagaggtctttgtagtagttctggaacttctctgagcttgtgtcgtaactcgtctggaacatgtcgttgtagtcagcgatgacgtcttcgaggaagtcacggtcatccttgcttagggcctgggcgctgcaatcctcgtcgtccaggatgccgtccgtttccgcctcgttgggtgcataggagtagatcagtccaatcttgagccgttggtccggggcaagatcggcctgctgatgctggaattcgatgtagtagcgtttggcggcttcaatggaggctgtggcgaacaaggcgttgaacccatgcacccgccgggactgtttgatttcctcaaccttgcgatgggagacaatcacatcctcgatgttggtcaccactgaatgctggtagctgtccatccgtctggtcttctgggcgaagtgatcgagagtgtatctgacgatctggtagattcgtctgctgtcgagcaatgcccgctcggtgtcgattccggcgacctgggtatccgtcacccttccttccccgatgctgtcgacgtagtcgatgcggaagggaaggacgttcttgtcacggatcgcatcgacgatggtgtaggtgtgaagcttgtcgccaaaggcctgttcggtcgttctgagcttgggtttgccgccggttcctgagttcttggcgaagatgggtgtgccagtgaaaccgaagaggttgtatcgcttgaaggcgtgggtgatcatggtgtgcatgtcgccgaactgggagcgatggcactcgtcgaagatgatcacgacatgctgaccgtagaccggatggtcagggttggccttgatgaaggtcgacagcttctgaatggttgtgatgatgatgcgggcgttggagtcctccagctgcttcttgagcaccttggtggaggtgttggaattcgcggcccccttctcgaaacggtcatactcccgcatggtctggtagtcgaggtcctttcgatcgacaacgaagagaaccttgtccacatcggccatctgggttgccaactgcgccgtcttgaaactggtcagggttttgcctgatcccgtcgtatgccagacgtagccacctgctgctctggtgcccagcttgcggtaattggtggactgcacgatgcgccgcaggatgcgctccgtggcgacgatctggtaggggcgcatgaccagcagcaggttgtcggcggtgaggacgcagtacttggtcaggacgttcagaatggtgtgcttcgacaggaaggtcttggtgaaggagcgcaggtccatgatcggtttgttggtggcatccgcccaccaactggtgaactcatagctgttggaggtctgcctccgcgtcgacttgccctgttttgcagcctcaccgatttgctgacgccgtgtggtgttggagtagtacttggtaagggtgccgttgctgatgatgaagatctgcacatactcgaagaggccggacccagcccagaaggaatcacgctggtagcggttgatctggttgaaggcctcccgcaggtccacgccccgccgcttgagctccacatggatcaaaggcagaccattgacgaggatggtcacatcataccggttcgagtacttggccttacctccgtctgcttgaccggggacctcgtattggttgatgacctgaagcttgttgttgtggatgtccttcttgtcgatcagcatgatgttcttgctgctgccgtcgtctcggcggagcacctgaacgctgtcacgctggatgtgcaccgtcttctccgttatgccctcgttgctgtcggtgatgctggtcttgaagaaccgctcccactcctcgtcggtgaagacgatatggttcagatcctcgagccgagcacggaggttggagatcagatcgtcctcggtgtgtatgggcagatactcgtatgcctgcgattgtaggattcggatgaactccttctcgagctcggcctccgactggtattcagcctgctcagcagccggagcctcatattcggcaacgacggtactctccgaagacaaggcaatcggatcaatcagatatgcggctgcttcgttcatgcccccaactccttaaaagtcaacagctgatcccggtaatattcgtattgcttgtgcctcatttccagctctgcttccagcgaggtgaatgagtcaagaatccgtacaatctccttctgcacttccagaggtggaactggtatgggcaaatcgtcggtgtcttttacgctcagttgtggaattttgacagaagttgattcggccagctgctgtaatcggttaaccttggtgagtagaaagtagtaaacaaatttttggtccacgcatgaatcttgcagactataggaccaaagttccgatttatgggtaaatggcttgtcataatagctaaaaccgatgtgaccacgtgatttaacgatgatgcttggttcattgataatatctttttggggaacgcaatcttctcggacatccgcgatcgtctcgcctccggcgaatattcgtaaggggcctggctgattcgcaagttggcgcatcctacctgcagtaatttgggttccgtggtttctccggcccaacgaggcaagtggtttgaattcaactccgtctgggcagagttcttgaataaggtcattgattctgctcatgcgaaatagtcctcatcgattcgtacaacctttaccgtctcctttgtttccactccaatgccgtaagcaatcatgagttgagtgagccgtttgccgtcgatcagaatgatccggcttggaacttcctgggcatattggaccgcccctgagctaaagctgctggtggtgatgaacaggcctccgtcagccttaccgctcaatgccccgacaaaactttgcacttccggacggtgcacggaattagtgcttccgtatcgtttggcctggatgtagattttactcaacccaagggcatcctgatcgatgattccgtcaatgccaccatcgttggtcagccgagtaactgtcccttttccgtgcgtgccaccatatcccatggcaatgagaaggtccataacgacatattcgaagaaggccggttctcgtgattgaatcatcgaaagcagctcggcagccacatcgctattgatgcgctcgacaccttcctcgatcatctcgattgggtctaatgctgtacagtcactcagacggttcgctttcggaactgcggtatcttcaatgatttcggtagcgccttttcgtacccaccaattatcgtcaggcttcgctaaggccctcaagtctttttcggtgatggctactggatactgcttaagtaaggtgtggccgatttcagtaattctgtattgcccacgagatggcctctcaattgcatcgacacgattgagatacgatacggcccaggttatgcgattttcggcaactggctgaccagaagagagctttgccgttttttgtgaatcacttaatgcgcagagcgttgttactttatggcgcagttcatggactggaagagtctctccagtagataaaacagccaggaccgggtggatgaactgttcccaagtcggtaatcctgtcatgccgagccctccaaatccgccacgattgcgtctatctgcgttctcagcgcctgctcgcgtttgactatctcgtcaatgcgctggttgagttcatggatgtcgatgtgctcgctggtgtcctctggctgcacgtagctggatacggcgatgttgtattcgttctcgccgatttccgaattttggaccagcttggtgcggtgttccacatccttgcgttgtgtgtaccaatccagtatctgctgacgattatcggttgtgagcttgttctggttgcctgagtgctcgaactggtcggaggcgtcgatgaactgtatgccattgtctcttttggacttcttgagcacgatgatgcaggtggctatggtggtgccgaagaagaggttcgacggcagctgaatcaccgtatccacatagttgttgtcgaccaggtacttgcgtatcttgcgctcagccccaccacggtagagcacgcccggaaactcgacaatggccgccgtaccgtctgtggacagccatgagaggatgtgcatggtaaaggccaggtcggccttggaaggtggggccagcacccctgcgggcgcgaagcgttcgtcgttgatgagcagaggattgttcttgccctcccaatggatggaataaggcggattcgacacgatggcttcaaagggctcgtcatcccaatgggcggggttcgtcagggtgtctccatgcgccagatcgaacttctcgtagttgatgccatggaggaacatgttgatgcgtgccaggttgtaggtggtcagattgatttcctgaccgaagaaacctcgatggacgttcctctctcctaagaccttggcaaactggagcaggagggaaccggacccgcacgccggatcatagaccccatccacctcggtcttgccgaccacggtgatgcgggccagaagctccgatacctcctgcggagtgaagaactccccacccgacttaccggcctgggaggcgtacatgttcatcagatactcataggcgtcaccgaaagtgtcgatctgagtgccctcatcgactcccaactgcatgtctccgatggcgttaaggagtcgagccagcttcttgttgcagtccgcgacggtgggaccgagcttgttgctgttgacatcaagatcgtcaaaaaggcccttgaggtcatcctcgctgggagtgcccactgccgagccttcgctgttcttgaagacccgctcgagcgtctcgttaagattctcgtcggtctcggccttggctcgcacgtttgcgaacagctcggagggaaggatgtagaagcccttctcctgtaccgtgtcagcccgtccgaattcagcctcatcgtcagtgatcttggcgtagtcgaaatcagtgttgccggcttcgcgctcgcccttgttgaggtagaccgtcagattctccgagatgaagcgatagaacagcaggcccagcacataggatttgaaatcccagccgtccactgacccacgcagctcattggccatcttccaaatcgtcttatgcagctctgcacgctctgcttccttggagccacgcgccatctagtccttcttcccttataagtcgatacctcatcgttcaaatggattggagtagacccaaccgaacaacagagttcagaataaggtcatcttatgacttgttagctttttaccgtagttggctcctccttctcccagcccatacgcgccgggaagggcggcggggtagtcaggcgccgagttctttccaatatgcttcggtgggttcttagatggattgttcggcggactagaataattgcgaagcctgctccctgggcccggccccatgagcccacgaactttgactggattccggcctgctccttaacggtcgtctgacttcttgcggggctggccaacgcacgcctggcgatcgccgcaagtcggcggcacttgcttgcctgagccttgtgtcggcgaaacattaaggggacgcattcactcagctcgagtttcctcctccgtcggtgaattgacggtcttcgagcatggccggtgggggtctgggaaggctccgcaaggcaaagctgatccgccttggttcgccaggctgcaaatatcgtccgcggtattcgagggtcgcgctctggcagccgcctggattacgcattccaatcaggagttcccggcactgaaggaaacccaggtgcaccgaggtccgggggtgtgccattagggcgctgaatcacgactagcggtgcgtgactgcgcagccgccgaatgccgcaactgtctgcacgggcctcctcctgccacccgcgatggagcgccctcagattcagcccgatcacggtgaagcgcttccgagctcccgtgggcatcgaccggacctcgtgctgacaagaccccgcgctgtccggcatcacgccttccagcacagggtcacccgctaattccaaggaatcagcagcttatgcttccaaggcgcgcgcaccaagaagagccttctcggcggccatgggcaccctgccgaggccgtcaagcccgatattgagcaggtagttgattccgtacttattcagatggttcttataggcgtggatggtctgcgcgctcttccaattctggtcgtgataggagaagccccaggaatcattgatggtcccggcggtctcgtacaggcccagcttggaaggtttgaaaccgacgatggaattgtagtccaccgagccgtcgtccacggtcttgacgctggcgtcatcgtcgtcagggatctcgttgtcccccagcgagacgtaatcgtaacgaccgttgcccagtcgggaattgatcaggcagtctggttggagacgtttgaccgtctcatagatggtctggctctgctcatcgcttagggtcatggggacatcgaaccaggcaacagcgatatcgccgtagttgctcatgatctcctcgatctgcgggaggatcttgtggtcgaatgcccgctgatagtccttctccccctggaagtcccaactgttgtcccaagtcgtgccggccgtctcgatgtcgttcgacagatagcctccgccatcaggatcgtgccagtcaaggtcttgcgagtagtagagaccgaagcgaaggccggccttgcgacaagccagggagagctcccctatcacgtcccgatggaagggtgtggcgtcgtaaacgttgtaggggtccaccagtgaccggtacatggcgaatccgtcatgatgcttggtcgtgaccaccaggtactgcattccgcacctcttggccagatccacgatggcgtcggcatcgaagtagactggattaaaggcccgggtcaaacgctcgtagtccttgttcggaatctgcagcttcgactggatccactcagcgtaattgctggatgaacgcccctggtactccccgccaaggagggagtacaggccccaatgaatcatcatgccgtacttggcttgcttgaaccactcagtgttatcgatcatactttgcttacctctttcccgaatcgcggaaacctgcctgcccatacgaccaatcaaatggtcagcttgtccttcctaacgatgaagacgtcatagaaggccaacaggatgtagcagactccagcgcacagaatcatgaatccggaatccctgttgcccaggatcaagccgagcgcttggaagaagtacggcgccaccagcgaaccaatgttgatgccgatcaggatgatggaggtggtcagattcattgaccccttcggcgaataggccaccatcctggccgtaagggccggattgatgatgccattgcagaagcccgccaccaggaccaggaccagcaggaccgggatggagttggcgaaaggcatggcgatcagcaccacagccgtcagcatctcgaagatgaagaccgtggccttgccgcaccacttagccaattgttcgaaggcaatgcccgaaacgatcgagcagagaaccaggaatccgaagatcctggtggcgtcagccgcggaaccgatatgggaatcaaccatgtggctggccagtttcaaggaaatcgacgagtagaagaggcagacgaagaggaagacgatggccagttgaatgacgccgccattggtggaaggcctgatgtccgaatcttcctcgacctccttgccttcttcgacggtgacacggtcgagccgcttgggcacgaagagggcgaccagcacaatcggcacgatcaggaagaggaacaccaggtaagtcgcatgccaggagacgttgatcaaaaagcccgcgatgaagagcatgatcgcatcgccaatggctccgacggaattcctccaaccaaggagcctgttcctgatccgctcagggaagatgtcggtgatgtaggacacgctcaggggcgtgaagatacccatgcctacgccaaacatggccctggagaggaatatggcggggtagctgtagaagaacgcaggtatgacgccgaagatcagggagacgatcagccccatcagtacggtgtacttcttgcccagtttattcgagatgaggccgctgaccacagtccccagaaggacgccgccggtgggaataaccacgagcagctcgacattcgcctctgagatattcgagaagtactgtttcatcagcggtattgtcccggacactgcattggacaccgacatcaggaaagatatggacaaaacgcccagcatcagcaaaggtgaactggtgttcaccggtttgtcgcccgttctcatttatgttcctttcaggtatgacgatcatcgcttcatcgcatggatagccttagcggaattgcttcgctgccttcttccaaccatggttccgaccaccgagtcatctttgccctgtagcccactccaggaatagtaaagattatatacttattgcatatgccaagcaaaacgacggcggccgcgtaagcactgcagtgacggacagctgacgggcgaacgaggggttgcggaaacaacccacgcagacaggagacacctcccccggaccggtccgaaacccatagtattcccggccttgccgcacgatggcgccccgaagcggaacagctggccaaaagacgccttggggcggctattcggttgaggctggcgcggctccacccatgccgggcgatttcggaaggcttgccgcgaacgagagcccagcggagcgcccccccccgcgtcgaagcacgaaagctgattacgcgttcctatgagcgatgactcagccgcctactgagcggatgccgccaccttcccggtacgtgttacgcggactcggtagagtagtctcatgcgacgaacgcaggcggacaggagggcgagcccgatgagcgtaaggacatccacaggccacaacgccgcaagcggcaggcatcggttggcctcgctgccctcggatatccggcgcagcaaccgccgcgccgtcctgcgcgccctctacccgaaccgatggcgctcccgtgctgacctggcaaaaatcactggcctatccaaggtgtcggtttcggatgtggtggccaccctgattgatgatggcctgctggtcgagggcggctacaagccctcctcaaagcccggtaagcccgccctactggtcggcatccaagtccagggcatgaacgtcattggacttgacctggcccaggcgggcaccctcaagggcattctgaccgacctggaaggccacgtgctggcccgcgccagcataccggcgcctgatgccaagcccatgcccttgaacccaatcatggacttgtgcaagcgtttgcaagaccagtccaaagctcccatcctcggcctcggcatagcaagccctggcacagtcgacacggcaggcagggtcttggccgcccccaacctcggctgggccgacctgagcctggcccaggctctgcgcgaggggctcggcctggaggtctgcctggccaatgacgcggacagcgcggtcttcggcgaacgttgtttcggaggtggcccggcgaacatgatcctggtccaaatcgcccgcggcgtgggggcaggcgtcttaatcgacgaccgaatcgtgcacgggtcgcactatgtagccggcgagatcgggcacgtcgttatcgacgagaacggcataccctgcgcctgcggcaaacgcggctgtctggagaccacgacctcggtgccatcactgaccgccaggatagcccaagcgcccgaacggcgcgaagagatcataaccctggctggtcaagccctgggttccgccctgtcaatgccggtagcgttgaccaatatcgacgacatcgtcgtggccggtcccgcgtccatcgcgaccgcgacgatgctggaaacggtccagaacaccatcaacgaccgggtgcgttcacgattcatcgaagcggtgcgcgtccgcccttcagccttgggttcggatgccgccgccttgggcggcgtggccggcgtgctccgcgagcgcctaggcgtcttttaggaccgactcgcgctatggggaaagcgcacagaccaagcccaacgggaagaaggcatgacccatgacacctcacaatccagcaccgccgacagcctgcgcaccggacgcgggtttggccctgattccccgcccgcgatcgctgacggccaccggtggggagttcctcctccccttccaggggcgggtgtgctaccaagggcctatggacgctcagtcctgccagacaggggccttgctcgccgagcaactgaccgacgaaatcgaagcggcttgcagctactcctgggatcatgcccaaggctgcctatggtcagcggacctgaccctgggcttggacccttcactgagcaagcaggcctaccggttgacaatcggcgggcacccagctggtgaaggagcatcgtcggcgcccatcagccttctgggcggcgacctggacgggctgcgctatgcggtccaaaccttacgccagatactgcggcagaccggcgctctcctgccctgcctgacgattgaggactcaccagtcttcccggtgcgttcctacagcctggacgtcacccgtggccgtgtccccaccatgaactgcctcaaagggtgggtcgatgcgctggcgctatgcaagtacaaccagctccaactctacgtggagcacgcgttcgccttcgatgggatgagcgaatcctggcgaggctgctcccccctgctcccgcaggacatcatcgacctggatgcttactgccgtttgcagggaattgagctggtcccctcgttatccaccttcggccatcactacgtcaacctgcgcacccgcacactgcgccgcttgggcgaattccccgaagacgcggaccggcccttctccttcatcgaacgccaggagcaccatacgcttaacgtggcggaacctgattccttcgcattctccaccgccatcatcgacgcctacgcccagctcttcaccagccgccaattcaacatcggcggcgatgagactttcgacctgggccgaggccgttcaaagcccttggctgaccaggtgggcgtcgataagctttacgctgactacctgacccgcctgtgcgaccacttgagttcccagggccgagagcccatgttctggggcgacatcgcggtctcgatgcccgcgatcctgcctcgtctgcccaagagctgcctcctgctcaactggctctacagtccaagggtggatgacagcaaggtcaagctggtggccgatatgggtttgcctcagtacgtgtgctccgcggtgcaagcgtggaacggtttgctgccgcgtgtgtccgacgcctggtccaatatctcccgcctgtccgcttacggccagcgatacggcgccgtaggctcgatggtgaccgattggggtgactacggtcatatcaacgatccagtcatgtccctgcctggcatggcctacagcgcccagtgctcctgggacacccagggccaggaccagcgctcgtgcgaccgtgccatcaccagcttgttctttgcagaccggtccggagcgagcatggcggccctggagcatgccagcacctgccaagccttctcctggagcgatttggtcacttacttggagttggacgacggcaagggtggcatcaaccaggatgtgagccgggttgtgggcctgatcaagggacagcaggcctggcaaggggccgatcagaccggtttagccggcgcccgccgccgctacttggagatttcggccgactcccttaccgccgtgccgcagaccaatgaccgtttgagtcaggcggcgcgcgatctggcctcttccttgaagagccctgcgggccagcctctccagctggcgattgaggggcagcgtctcttcaatctgctgggctggcagctggcccggcgtgagggtctgctggcggatgcgagcggagctggtgagagcgaggcgcgggctctggcgggaggcctggagacatggttcgaggcctatcggtcccgctggcggaaagtgagccgcgaggccgagctgagaaaggtggcgaccgtggtctgggccttcgctgacatgctccgtcaaggttgaacacccatcccacctcgcggcaccagccgaagtcaggcgtcggcctcctgatgcatgaacggcggctcggggttcatccaggagttcctcactctctggctaaccccgagccgccgctttcgccataggcaatgccagcgcttgaatctgccccgccgttaacgctttccgccgtcatcctgaccggatggaccctcgtcgtcgtggttctcaccatgctggcttgaatcgcgttggcctgcgccctcctgacgcgacagcttgctgcgtaggaaatcggtgattccgtgggccttagcctccgcctgtgactccaggtgggtgtcatcatagccttgcatgtaccgcgtctcccgccagtgacggatggaggcgtttgttccgcgatgatgcacatggtgctggagaggcgcgccgccgaagcggtcctgatccacctctttggcgaccgcgatctggttgacgttcgaggcgtccataatggccaggggcggaaccggttcgacatcaaccggcgctgcaggggcagcggtgcgcttctgcatgcgctctggcaggattcgcgccaacttggacaggaaggagcatgccacaaagtagatgacagctgccacgaccagggtttggaggatgttgaagtgcatcgaacccagacgccgggactcctgaaggaggtcggtgtacatgatgatcgagcccagtgccgtgtccttcaacacgacgaccagctgggtgaccgctgctggcagcatggcgtagacggcctgaggcacctccacctgcatcagcgactgggtctgcgtcagccccaaagccaagcaggcttccctctggccgccgggcaggttgcccacgccggagcggaccagctcggccacgactgaaccgttgtagagaatcaaggcgagcaccacggcccagtaggaggcctcgctgacgccggagaatgcgaaccagcgccagaagaaaatcatcagcatcaggacaggcacggccctgcagaactccacgacgacccccgagaccgcccgcacgatcacagagggcaggaggcggccgatgccgaagagaaagccgaaaacgaccgagccgatcaccgccacgatcgaggctttgatggtcagccagagaccaggcaggtagaagtcggtccaggcttcggtgtccaaggcaggcttccacaggtcccatgcgagctggttctcgccatccggcggattgtgcaggcgcaagagaatcagaacgacgatcaaggcgaaaaccacggccgcgatccagttgacgattttaatcttgcgcaagcccttgggccctggttggtcgaacaggagggagctttcattatttaacttggccaaggtgaatcacctcctgacggctagcttgttggataagaaggtggtcaaggccccgaccggcaggaccaggattacgtatcccagggcgaaaatcaggaagatggcgacgatcgagttggcatggaattcaatcatttcgctcatcagggaggaggattcagtggccacggaggcggcggccgcgacggtcgagttcttgagcagggcgatgaaagtgttgcccaagggcgccaccgatccacggaaagcctggggcatgatcacctgggtggccgactgggtgaaactcagacccaaggcccgagccgcctcagcctggcccaagggcaccgtgttgatgcctgagcgcagggactcgcagacgaaagccgccgtgtacaaggaaaggccaacaaccgccagccagaagaagttgaccgagaacttgtccgagaaactcagcttgagctgtgcgaaggccccaaggaccatgaacaccatgatgatggtcagaggcatgttctggaagaactccacatagcccgaagccaccttcctaagcgaggagaccggggctatgcgcatgatgaccaggatgatgcctaggatcagggagaagagggcggaccacagggtcagctcgatgttgaccaggaaggctcctgggatgtcgtactcgctgaagagttggatgatggctcccatttactcgccctccttcggccttggagggttgtatttaaggtccggcttgaagtgcgcgccccgggtattctcctccagggcacgctgccaggaaccgttggcgatcatctcgctcagggcggcgttgattttggtagccaaggccttgtcgcccttcttgatgcccaccccgtaatactcctgggtgaagggtttgccgaccagctgcagacggccgcgggccgacgatgccaggcccgccaggatgatgtcgtcggtagtgaccgcgtccacgatgccggagaagagggcggtggcgcactcggcgtagccaggctgctccatcagctgcacctgggaggcgaaccgctccttgactgtgaccgccgaagtggagccggtcaccgagcacaggcgcttaccgttcaggtcctggggccctttgatgccggtctcaccggtgcgcaccatcaggtcctggcccgccacaaagtaggggccggcgaaggagacggccttcttgcgctcgtcagtgattgagtacgtggccaggatcatgtccacgtcgccgttctgaagcatggcctccctctgcttggagggggcctccttccagatgatgtcgtcctcgctgtagccgagcttcttggcgatgtacttggccacgtccacgtcgaagcccacataggtgccggacttcttgaagcccaggcccggctggtcgaacttgatgcctatccgaatcttgccctcctccttgtccgacccgcaggccgtcagggagaagacgcaagcgagggcgcacaaggccgctagcagggctttcgccaccgcccgcccgcgcgcgctgagcttccataccgtactgctcatccgttcgtcttctctcgtctcatacattagcgccaaaactcagtgggtcaggatcttggagaggaattcctgggcccgctcgctctgggggtggtcgaagaattcgtcaggcttgccttcttccaggatgcgcccatccgccataaagacgatcctgtcggctgccttgcgggcgaagcccatctcgtgtgtgacgcaaatcatcgtcatgccctcctgggccagctcgatcatcacgtccaggacctcgttgaccatctccgggtcgagggccgaggtcggctcgtcgaagagcatgatcttcggtttcatggccaaggcgcgagcgatggcgacgcgctgctgctggccgccggagagctgggagggcatcttggaagcctgggactgcacgcccacgcgagccagaaggtccatggcatagtcctcggcgtccttgcgggccatgtgccgcaccttgatcggcgccagggtcacgttctccagtatggtcttattcgcaaagaggttaaaggactggaagaccatgcccacctcggcccgcagtcgggccaggtccttgccttcctcaggcaggagttcgccatcgatccggatgactcccgagtcgatggattccagcctgttgattgtgcggcacatggttgatttgccggatccggaggggccgaccacgacaaggacctcgccctggcagacctgcaggttgatgtctttcagaacatggaggcggccgtagtgcttctcgacatgggccagctccaccagcggccgagcgccctcggagtccgcctgcacggcttgaacgggcgcaagccccgccgccgtttgctgtgtattggattcgctcatatatcagcattgtagccatagcaggtaacaggcgcggggctttcgattacaggcgcgtaaacgaccggctgcagggttgaaggactactgctcggcctccgggtcgtagtccacaccggtctcagcccgctgctcaggcggaatcggagctggggctccggtcatgggatcctggccgccaccggatttggggaaggcgatgacgtcgcgaatcgagccgaccccagccaggatttgcgccacgcggtcccatccgaaggcgataccggcgtggggcggcgcaccgtacttgaaggcctcaagcaggaagccgaacttctcctgcgcctcttgtgcaccgattcccaggaccttcaagacccggtcctggatgtcggtgcgatggatacgcaccgaaccgccaccgatctcctcgccgttgcacacgatgtcgtaggaatcgctcatcgcatgctcagggtccaggtcgaaacggtcgatccagtcagctgagggcatagtgaacgggtggtgcatggaggtccacttcgagtggcccacagccacatcatcgtcatccgggtcgtcggtgggcttgaacagggggaagtccaccacccaggtcagggcgaactcgtcaggcttgaggagtccttgcctgcgggcgatctccacacgcaccgcgcccaagagcagctgggaggaggcgcgcgggccagcggcgaagaagaccgcgtccccgtccttggcgcccaccgccgcttgcaacccttcgcgctcggcggctgaaaggttcttggccactgggcccttgagctctccaccgccggagaactgcacgtaggccagacccttggccccacgctggcgggcccaatcctgccaggcgtcgaactgccgacggggcaggctggccccgccctcaaagacgacagctcctacatagggagcctggaagacacggaacggtgtgtccttgaagtagtcggtcatctcgacgatctggttaccgaagcgcaggtcgggcttgtccgagccgtacttatccatagcgtcttgccaggagatgcgcccaatcggcaacttgacctcgtagcccgcggccttccaaatcgcggcaatgacctgctcggccatggccatcacgtcatcctgggaggcgaaggacatctcgatgtccaactgggtgaactccggctggcggtcggctcggaaatcctcgtcacggtagcagcgggcgatctggtagtagcgctcaaaaccgccaaccatcagcagctgcttcaacagctgtggagactggggcagggcgtaccaggacccaggcaccaggcgggccgggaccaagaagtcgcgcgccccctcaggcgtggacttgatcaaagtgggcgtctcgatctcgcagaaatccatcttgtccagggccgcccgtgccgcggcgctcattttcgagcgcaggcggatggtcctttgcatggaggggcgacgcaggtccaggtagcggtacttcagccggatgtcctcaccgggaagcttattctccgcttcgttctccagggctgtggacacctggaagggcaaggcgtcggacttggccaggacggtgatggactgcgcgacgatctcgatgtgcccagtggccaggtgctcgttgtcgttgccttccgggcgggcgcggacttcgccggtcacctcaatcacatactcggaacgcaagggccgcgcctgctcctcgtcgtagatgacgatttggaccaggcctgtccgatcgcgcaggtctatgaaggccactccgccgtgatcccggcgccgatccacccatccagcgaccgtgactgcatgcccgatctccttctcggtgacttcagtggcgtagtgggttctgtaagccgactggctcatgcttcctcgttcctccatccaggctgggcccgccctctgcggtcagtctgcgtcagacagtgattgcacgctctgctgggaaaacaggctatccggcgtccacgacacgacttgcgcgggctcctgactgccagtgacgatgttcttgacctggtccccgtcagcttcgtcaccgggctgggccgggaaccagacgtaggggatgcccagatgatcggcgtatttgatctgcttgccgatcttggcggcggtaggggccacatcggctgcgatcccccgctggcgcagggcgtctgctatgtgattgctgcgggagcggtcatcctcattccagaccgccaccaggaccgccgccggggacacccgtgacgcatgggccccggcttgggagagcatgtaggacaggagacgggacagtcctatcgacaggcctacgcccgggtagacgcgcgaaccttgggaggccaggttgtcgtagcggccgcctgagcagatggagcccaaggattcggcaccctccaggaaggtctcatagaccgagccggtgtagtagtccaggccgcgggcgattttaaggtcagcgacgacggccccggggcggattcgagccgcttcgtccacaatcatggccagggtgtccagcccctgccgggccagagcgtacgactggctgtcctcctcgatgccgtggctggagcataggcggtcgaatccatccctgagctcctcgccgtcgtcggcggtcagcccggccagctccaggcaagcggtagcctgggcctggctggccccgcactgggagaccaggagcttgcagacctcatcagggccgatcttgtcaagcttgtcgatctcgcgcaggacgccctcgatgtcggtcaggcccaagcctcggtagaagccttctgagagcttgcgattgttggcgtgcaccgtggccttggggcagccgtaggggcggagcgcctcgagggcggagaccatcaccaagggcagttccacctcgtagtggtcaggcagctccccattgccgatcacgtcgatgtcggcctggacgaactcacggaaacgaccttcctggggccgctcaccacgccataccttttgaatctgccagcgcttgaaggggaaggtcaaatcccccgaatgctccagcacgtagcgagacaggggcacggtcaggtcgaagtggagccccaaacggtcctcgaccggcttaccgtcctcgtgccccacctcctgcaaacggctcagcagatatatctccttgctggtatcgccttttttgagcaaggaggagccgggttcgaccgccctggtctcgatgcccacgaagccgttgagctcgaagacatgccgtagcgtgtcaatcatggtctgctccaccacccgctgggaggggagccactcgggaaatccggataatgatgcgcctttagccatagctccctataataggaggtagaggggagaagtggcgctaacgcgcggtgcttccccccgtctccacctcacaagcttaaaggagctggcaatggccgacgagactgtcaccacacccgagaacacccctgcgaccgaaaggcagaatcagcggcaaggcgagcagactgtcccggccgccgctcaaacaccccagcccgccccaagcgaccagcaggaggaggcggccccgtcccaagcgggcgctcaacccgcccagcccactgcgccaaagcctggagccccctcccccgcggccttcgccaagaagactccgcacatccccgcaacgcccagcgcgcccagttataacgcggatgagctcaaggccgcggaagccttcggccgggtggacgaacagggttcggtgttcgtccgtgagggcgaggccgaacgcgaggtcgggcaattcccggacgcagccagcccggacgaggccttggaactctacgcccgccgctaccttgacctcaaagagaggctggacttgttcgccacccggctcaaggccgccaacatcaagtcccgggaaatcgacgaatcactgaagtccctccaggaggagaccaaggagccggcggtggtcggtgacatcgcggccttgcgtcagcaactgagcaccctggaggacgagggcaaagccaagaaggcccagctgagtgaggagcgtaaggcctccctggacaaggccattcaggagcgtaccgcgctcgtcgaagaggccgaggccatcgtcgctggcctgggggaccagacgaactggcggcagacggcggacaagttccatgacctctttgagcgttggcagacccaccagcgcactacgatccgcatcgataagaaacacgccgatgccctctggaagcgtttctcttccgctcgctccgccttcaaccaggccaggcgcaagtgggcccaggaacgcgatgcccaccgggccgaggccaagcggatcaaagaggagatcatcgcccaggccgacgcgatcaaggactccacggattggggaggcacctccagggaattcaatgcgatgatggaccgctggaaggccgccgggcgcgcgggacgcaacgaagacgacgccttgtgggcgcgcttccgccagtccgctgacgtcttcttcaacgcccgtcaagccgaccgtgagaagacctccaccgacgagcaggagaatctgaaagccaaggaggcgctgttgacccgcgccgaggcgctgctcccggtcaaggacgaatcagcggccaagcaagcccgccaggccctggccaggattcaggaggagtgggaccagatcggctacgtgccacgggccgacatgcaccggatcgagagccgcctggacgcggtggatcggcaaatcaagtcggtcgaggacgccgtctggcaacgttccgaccccgaggccgacgcccgcaagtcctccttcgagacccagctggagtcccagctcgctgagttggaccagcggatcgctcaggaggccgacccggccaagaagcaggccttgcaggccgaaaaagccaccaaggagcagtggctcaaggccgtcaagtagggtgcgacgcggtcggcgccgtacgcgagataggcccggcccccactatcaagcgggggccgggcctatccgtatctactgaatcctcagcctgattaacggtcagaccttgcgcatacgcgaggaggacgaatccttggcgccggtgattcggtaggcgtcaaaaacgccatcgatcttacgcaccgcggacaggagtgtgttcaagtgctgggggtccgccatctcgaagacgaactggttgaccgccacccggtcgcgcccggtggtctgtgagccggacaggatgttgaccccgtggtcggccagaacctgggtgatgtccgagagcaggtgcggccggtccaaagcctccacctgcaccttgaccataaaagtcccctggttgctggaccaggccacgtccacgatccgctcagggtgatgcttctgcaagtccagcatgttctggcagtcgtcccggtggacggagaccccctggttgcgggtaatgaacccgacaatgcggtcacccgggaccggcgtgcagcagcgggccagtttgacccacacgtcgtccacgcccttgactgagatgccctcggaggaagagaccgcatgagcccggctcacctggctcagcggcagggcttcctgctccacttcgtcctcaaccacggctcggcccacatcgtggaccaagcgtgagatgacattctgtgtggacacctggccgtctccgatggccgcgtagaccgcttcctcaccggataggctgagttcgtcggccacgccgatcatcgactcgggcgtgaccagggcggataccgggaggttgcgcttgcgcatggcccgggtcagctcgtccttgccttcctcgatcgtctcggtacggcgctccttgctgaaccactgacggatcttattgcgcgcccttggggatttgacgaaggagagccagtcgcgggaggggccatcggtatccgattttgacgtcaggatctcgacggtgtcaccgttttccagcttggtatccaagggcaccaggcgtccgttgacccgtgcgcccatggtgcggtgccccacttccgtgtggacggcataggcgaagtcaaccggcgtggactcggatggcagcgagaggatcttccccttgggcgtgaaaacgtagacctcagccgcgcccaggtcgtctttgagggagccgaggaactcgttggaatccggcgtctcgctggtccagtcggccaactgctgaatccacttgaggttgtccgcctcgctcaacccgccttgctcgctgcgctcccgcttgacgtcggtcttgtcaggggctgagagctctcgtcccgcctgcccgttctccttgtacttccagtgggcggcgatgccgaactcggccctgcggtgcatgtcccaggtgcggatctgaatctcgaccggcttgccccccggacccaccactgtggtgtgcaaggactggtacatgttcatcttgggcatggcgatgtagtctttaaaccgcccaggcacagggctccaccgcgcatggaccgcgcccagggccgcgtagcagtcacgaatggagtccacgatgatgcgcacgcccaacaagtcgtagatgttctcgaaatcgtgcccacgcacgatcatcttctggtagatggagaagtaatccttaggccggcccgtcacataggcctggaccccttgggcgtccaagtcctcgtgaatctcgtcgaggatctgcttcaggtagacatcgcgctgaccggcccgccttgagaccaaaaccacgatttcgttgtatatcttcgggtaaagggtcttgaagctaagctcttccagctcggtcttgatggcgttcatgcccaggcggttggccagcggggcgtagacgtccaaggtttcccgcgctttgcgctgggccgacgaaggtttgacgtaacgccaggtgcgggcgttgtggacgcggtcggccagcttgaccaccagcacgcgcacatcccggctcatggccactatcatcttgcggatggtttcggcctgggccaggtcaccgtagtccatcttggaaatcttcgtcacgccgtccaccaaccccgcgacggtgtcgccgaactccttgcggcactcgtccaaggtgtaatcggtgtcctccaccgtgtcatgcaggagcccggccgagaccaccgtgggtcccatgcctaaatcggccagtatctgggagacggcgagggggtggatgatgtaaggctcgccggacttgcgccgctggttggcgtgctgcttgaccgcacgctggtaggccttcggcagcatggacaggtccacgcccgggtggtggccccggcaggcctgggcaatcggctggagggggttgagggggtcgctggaaatctcgcagccgagcgcgcgcgaggaggagccggagccctccctactgacatcgttgtcgcacactctgccttccatagcggccatgtcactcctctcgccgatgatgtgcacctatcctacacgagctaatcgcatacgggcaccggttccaccatcctgcggacaagtcacaggccggtcgacccgaagccccggtcgccgcgctcggagtcaggcaggtgctcgacctgatggaaatcggcgtgctcgtaccgttggatgaccaactgggctattcgctcgcccctctggaagaccgctgtacgctcgggatcaaggttgatcaggggcaccttgatctcccctcggtagccctcgtcaatcgtccccggcgcgttcaggaccgtgaccccctgcttgaccgccagacccgaacgggggtggaccaggcccacataaccagctggcagggccagggcgattccagtgggcaccaaggcccgctggaagggggctaaggtcaacggctcccgggcgcgcaagtcggcgccggcatccccctccagggcatagctcaggtatgcgcccaggtcgtcctcgccagggcctggcccggatcccattgcttgaatcaggactctcaggccctgagggttggctgctgcgccgtcagtcgtcatcaggcggcgcactccttgcacacaggctggccgtccttggtcatgtaggccagctgggagcggtgcttgaccaggaagcagaccgagcagatgaactcgtctccctgcatggggatcacagtcaccgaagagtcctcgttgctcaagtcagcgccgggcagctcgtaatcctcggcgatggcgttctcatcgtcgtcaatgtcggcgggcgcctcctggctcttcttgccgagctcctcgatcgaagcctcgtcctcgtctttctcgcgcggggaatcgtagtcttgtgccatcgcacgtcctttcagtcatgaaccatttccgccacgtccgccggctcgcgcccggcagccccttttgccgctcataggatacacggccatactgcggataggatacacgaatacgatgctcgtaaaataccacctatagggcacaatagtggagggacgctcatagcatgggaaaagaaggtggcggcatgcctcaggaagagatcaggacagcccgcttcgatcacgtcagcgatcagggcgatttagtgttcaagtgcgagcgcggcctgttcgctgtcaccgtcgataacgccctggatcgcgccattcttgaagccaagcaggtcctggaggaggagcacggcacgccggtcccacaagcctcggccgccctgcccatctccgcgatccaaaccgcgattcgagctggcacctccaccgagcgcgtagcccaggagttcgctgtgaacgaagctctggtacggcgtttcgcgagcccgatcgaggtcgagaaaaagtacgctatcgagcagttcctctccatgtcctcacccaagcgcggggccggatactccaatgaggaagccatcagccgggccttggacgccgccaatgtgccgctgggggccgtgtcgtggaccgcgacacgccgaagccaggggccttggaagatacgcgcgtccttccaggcgggagggcaagccatccaggccgactggacctggaatatgaaagagaacacgatcacctgcctgaacaccccggctcgccagctcttggaaggttccgacgccttcatgccggccccggcgcccacgcccgaggacgtcgccgcgcaggacggatacgcgcccctgccaccggtgcaggcgcctcgcggccaagaccctaccgatgatggccccctggcccagcggacggaccatgcccagacacagaccgtagaaatgaacatagtgcccgcccctgaagaccaggccgagccggaaccggcgactgagcccaagccggcatctgaaaccgaaccggcgcccgaaaccgaacccgtgactgtggcgcaatccgagccggcggcaggtcgacaggagcaggcgcttcccctccaacccgccgctcaagcacccgcgtccccaagggctcaggttcagaccggtcaaggggtgcagaaggacgatgaagccgccgcagccccggaggaccagcgctaccccgcgcctcccccagccgaaaccagcaccgaggaccgggaggaggaatccgccgggtcgtcggccagcgagcccagcgccttgaccgcttggatgtacgggggaagcaagcgggtgaaggcgaaaaagaagcctaaagtctcctcgcgcaacaaccccaagggcgaggcccaagcgccggaaccagcagtcagctccagcgcggcgcttccgtcccaggcgacatcagccaactccagccaaccagatgcagcgccccagtcccctggggcgaccagccctcaggggactgagcaggcggtccaggagccagggcacgcgcaatcccggcgtgtcagggaagagccggaaacccgtagcccccacaagaaatccggccgctcagccgtcccctcctgggacgaaatcctcttcggggactgacccctgctgtccttgccccccctcccctaaaccaagtccaccaagcaggggatgtcagtctccaaataggtctgtgaaccatgcacgccgggcatgtaggtagcctgttcgccctgcgtgcgcgagtccaccaaagtggtgcctcctatgcaggaaatcagcaggtcaccgataaccggctcattgcgcgcctccaccgggccgaacagacctgcggcgagcgcttgggccttggtacgcactagcgccctaccagctaaagcttcgcgccaacgctgcgctgccagctcagggtcaacgccctcctccaagtagagcatgacctgacgaggctcgccgcccaccaacctgaccccggcctgaaggtcctcccgctcggccatatcgaagcgcaggttcgggtcggctgtgaccatcccgtggtcagcgacgatgacgattacggtgcccgctggtactgaccggctcaggagggcaaggtcggcgtcggtctgctccagggccgcgacccactcgtcgccctcccagccgtaggaatgccctaccttatccacctcgcgcaaatagaggtaggtcaggccaggttccctggcggcattagcggccgtataaacccgctgggtggaggttcgcccaacaatgtaatcggtcccccgcagggctgcgcgggtcaggccagagtcagcgaacttgggcagacctgacgtagtgacgcgcagcccctgggccttcagacgctcgaatatggtgggctggcgttgcatgtcctcgggctccagggcgttgcggaactgaatcaattggctcaactcgccgttgctcgggttgagctgggtgtaaccggccatgccggtcaggcccggacaggtgccagtgccgaagacccccatggccgcggccgtcgtggaaggcaggcaagtggcgatgggcctgtcgttggcctcctgcgacagcaaggaacgcaagtagggagcgtgccccaggcggcgctttaggttccaataacccagcccatccaccaagaccacaaccgcggaccgggcggacggcaggcctaggacctcttgcaaggccgcggggtccgggtgaacaggggtggagacaggcacgcccaggaccgaggagagagccggcaggacagaggagaggtgagctgcctgcccacggccggctgcggggccggacccatccccgtaagtgatgtcgtctgccaagtcggtcaggtcgcccatgcatgaaaaatcagccatacccccattcaaccacgagttcgcatcaggcgcagctagaaaaagcgggcggcggtcggaccagtgccttgggtctggctgccgctattatggggcagcggacgcacaaggcaggagctggcagtatatggcatcgcatcgcaagagcaaccccgggtacgacatgcggcagatcaaggaacacatcgttgaaacgcccctgggcgaggagatgagcaaatccttcctggagtatgcctactcggtcatctacgcccgggccctgccggacgcccgggatggattgaagccggtccagcgccgcatcatctaccagatgggccagatggggctcacgcccgacaagccttacatgaagtccgcacgcgccgtcggcgaggtgatgggtaagctccacccccacggcgattcctcgatttacgaggcgatggtccgcctcgcccagcctttcgccatgcgtttacccctggtggatggccatggcaacttcggctccctcgacgacggccctgcggcctcccgttacaccgaggcccgcctggcgtccgcagcgctcggcatgaatgccgatatcgacgaggatacggtcgatttcactcctaactacgacaacaaactcaaagagccgaccgtcttgccctcggccatccccaacctgctggtcaacggttcctccggcatcgccgtgggcatggccaccaacatgatcacccataacctgggcgaagtggtcgcggcggccaagcacctaatgacccacccgcaggccagcttggatgagctgatgacctacctgcctggacccgacctgcccggcgggggcgtgatcgtggggcgcgagggcatccgtcaggcctacgagagcggccgcggcgctttcgtgacccgctccgtgacccataccgagaacgtgaccgcccgcaagaaggccatcgtcgtgaccgaactgccgttcatggtgggacccgagcgggttctggagcgcatctccgagggggtcaagaaccaccggatcgaggggatctccggcgcgattgacctgaccgaccggcacaacggcacccggttggtcattgagctcaaatccggtttcgacccagccaaggtactggcccagctcttcaagtacacccccttggaggactccttcacaatcaacaacgtggcacttgtggatggccgcccccacacgatgggtctgaaggaactccttgaggtctggatcaagcaccgccgtcaggtcgtgcaccgccgatccaagtaccgtaagcagcgcgcccaggagcgcctgcatctggtggagggcctgctcctggccatgatcgacattgatgaggtcatccaggtgattcgcacctcggaggatgccgacacggccaagacacgcctgatggcggtcttcgacctggacgaggtccaggccaaatacatcctggagctccgtttgcgccgactgaccaagatgagccgaatcgagttggagggcgagcgcgacgaactcaaagagcagctggaggccctggagctgattctgagttccgccgccgaactcgacaaagtggtggtagacgagatggaccaggcggtccaggcctggggcagcccacggcgcaccgtcatcctggacgcggagccttccggcgatctggagcccgtggcccttcaaggcgggtccgatcccaagctcacccagggcgaacgaacctccgacctgggcttggccacggtcagcgcaaaggccgcttcgaccgcggacccggtcgcaatgcaggtcaaggacgagccctgcaccctcctgctgagcgcgtccggcttgatcgcccgctcaggcgagggggcccttgacctatggcgcgcccgatccgcagccgatggacgggcagacgacgatcaaatcgtctccatcttcgtcacccacacgctggccgactatgcattggtcacatcagctggccgtctggtcacggcaccggtggccgacctgccccaggtgcccatgaccacctcgctgagcctggcaggcggagtgcgcgccgatgagctcattggcggcactcattcgaccagcccggtcgagggtgaacgcactgtggccgcgattgacctgtccgaccaacgcccgctagggcttggcacccggcaaggcgtggtcaagcgttggaaccgcgtctcccccagcacgatggattcctggtcgattatcgacctgaaggagggcgacagtctcctgttcgcggctccagcggccgatgacgaccgcatggtcctcatctcctccgactcctgcctgctcacttacgaggccgccaaggttcgcccgcaaggtaggacttctgctggcatgaccggcatccgtctggccgagggccgcaaggtggccgccttcgcggtcgtgcccgcggggcaggtctcctggacctatcgcgagggagagaacggcttaaccagccagtccggggccgtggtcctgactgtggcgggttcgggcgaggccctgccgggcactgagaacggcgccgctaaagtcacccccctgcagatgtacccggtcaaggggcgcggcaccggcggcgtgcgctcccagcgtttcctcaaggggcaggaccagttgatcctggcctgcgtaggcccctggcccctgcgcgcttcgaccgcctcgggccgtccggtcgacctacctgacgtggatatgcgccgtgatgcttcaggacaggacctggcggcgccaatcgcctacgtcgcttgaatcggccggctctgccgcttccttctagcggtagagcttcatgccctgcgggccgaaggtgaatccggcattttggaggctccggctgattggcgaggcgacctggaacggcaggccattgacgtccttgaatgaggcgggtcgtcgctgggaacgcaggcagaccgccagttcttcacaggcccgctccagtccgggctggtttacgccttcgaaaacgagcaggtgacgaccctgcacccccgcgtagagggcgggtcggccctgccagaaggcgaccagcgcgccgggcctgcggctagggcgcacaacctgggagcctttgggctcagccagtggcggccagggcaatacgccaccatagaggtttgctggatcgcgggaatcaatcaccagggccgtcccagcttccgtacccgtccgcgaggagggttcccccgcttggtcccgaagcgcgctgaccacctcgcgctcagcgaactgggtgggtcccaagccttgcacgaacgctccccgcagcagctgtccagcatcctccatgcgcttgaataccggatagaggtcagtgaaccgcatgggcgcgtcctgctgattgaccgtcggtgaggtcgcaagcccgtcgcggtccaggacctgctgagcggcctccaatgcctggcgggtcaagtcttcggtcgccgctggctgggacgggcccatcgccaccgcctgaggcagggaccataggccctgtgaggccgcctggagcaaacgctggtcgcggtccgcgccagccagggaccggccccccgccagcgtccgaggattgacagccgcccgggccctgcggcgcaggctggcgctcggcctggggtgacgcgctgctcgctcgcccagaagctgtcggatgggagccaaagtggagttggtcagcctcccctgccagaccaagcgccagagggccaccgcaagccgctcggggtccagcgactcaggtccaccctgctggcagatggcttccaactgcctgaaatggtaagagccgccagcggcgagagctttgaggataggctgggaggaatcctggcccaggtccgtggcaacggctgcctcaccttgcccgtgcttcgctcccccggttcccgttaccgcccgtgacattgggagggccaggaggggtgaatcggacaggtaccaagcgagggagccgaccgactcgcctgcctgcctgcgacccaaccagataaggtctccagcggctaggagctcgtcgatcatcgccggctcgtaatcagccacccgcgtcggcagaaaactgctctcccacatgtcggccggcaggtagaccccctcataaacctctaacaaactcagaaggcctgaggcaccccggtagcggcctcggcccagcggacccaccccctgccgtttcagtaggaaactgctgtaagctgcgggcttcaccggtcgcacagcccgacgtgcctgcttcaaggaacgcgaacgtagggattggaaaaccctctggtgaagccattgccgtcccgctccgcgctcgttgccaggtcctccattggagccttgagcggcagtggaccgccactgcataatcagcccctccccctccaggtcggccaagagccggctcagggccgaggggtcaaacccgtagcgttccaccaaatcttgcctggtaaagggcccgtgagtggcagcgtagacaagggtcagctcacgcatggccttcggggcgtcctcccgcccgtctcgcaacgattccagacgcacagcgtcatcggggctcgcccagtaggtttcacccccgaccgtgaccgaacgcgccctgccttgctcgtgcaaccggtccaggaacccaagcgccctgccgcgatcgtcccccgcaccgggcgagccggactcgtcagcgggtttgagccgggccgagagctccttcaggctcagaggccctagcgaacgcaggaggtcagccgccccttccgcgtccttcttgcgcctgtgcggagacaggcattgcaggtcagcctcaagggtggcaacctgactgggatcaatcaggtcctgaacctgtgagccgccgatcagcttggccaggagaacggaatccagggagagcatggcggcgtcttgttcggcctggggcaagtcgtattggtacatgtaagcgctgacatagccgaacaagagcccggtcgcgaatggcgagggagtactggtgctcacatcacccagccccacctgcccggactccaaggctttcatcagggtccgcaaggagggcaggtcgtagacatcctccaggcactcgcgcatggtctccgcgagcaaggggaagctgccttgctcgcgggcggcttggaggagctgggaggaccggagtcgttgaagccagagaggcaccctgcgcccaggttgggccttgggcatgaagagggagcgggcggccacctggcggaagcgcccagcgaagagggccgactgggttaccgccgtgcggacttcctcctccaaacggtcggggtcgaagacgaataaatcctcggccggcaaatccccatcctcctgagccaggcgcatgacgatgccgtcatcggacgcgtagacggaaccgtcgtagccccgctcccgcttgagcctggcgctgatggcgagggcccagggctcgtggacccgggcgccatagggggaatgcaggatgatccgccagtcgccttcttcgtccttgcagcgctccaccaggagctcccggtcgctgggcagcaggccggtagacccctcctgctcggccaagagagaggccagattaccttgtccgttggcgtccacgccagcccgggacaaccgtcggctggtcctggaatcgaatcccgccatcccccttggagactgggatgccggaatcagtcccgccgcaaggtcgcgcgtgagccgacccaaacgacggccgaaaccagcgtcgcggcccacaccctcgccgtgccagaagggcaggcgggcggaacggccaggcgccggttggacgatgacccggtcgttggtgatttgctggatgcgccaggaactggtgcccaaggtgatgatgtcgcccaccctcgactcgtaaaccatctcctcatccagctcccccaccctccgaggagctcggccagagcccgtctcctcctggggcaagaccaccgtgtagctgccacggtctggtatcgtgccgcccgaagtgacggccaagcgctgggcgccgggcctggccgacaggacgccggatcgctggtcccatgccaaggacggacggaaagcgcgaaagcgctcatcggcgccaacaccggcgagcatggccaggacgctttcgaatacagcccggtccaactggctgtagggcgcagcctgcctgaccacgtggtaccagtcatcaaccgccatgtcatccatcgagacggctgccactgtctgctgggccaacacatccagcgggttgtcgggcaccttagtgggctcaatcgcgccctccagcatggcctcgacgctggcggccgcaccaaggatctcccggcggttaagcgggtaaatcaaggcgtgcgactcggctcccacctgatggtccgcccgtccgacacgttgcaagccggaagctacggataggggcggagccacttggatgaccaggtcgatcgctcccatgtctatgcccaattccagggaagacgtggctacgacgcagcgcaggtcacctgccttcagggcttcttcaatcatcctccggcgctccttggagactgatccatggtgggccatcgcaatgggactcgagctggtgcacacacgctgggagatggatccccctgtcgatgcgtaatgaacgccgctcccgtccttgccttgggagcccgccaaaccttcgcttgccgcagaagcgggggcgggcgccggagtggccagctcattgaggcgagcggtcagcctttccgcctgcccacgggagttgacgaagaccaaagtcgtacgatgggcgagcaccgcctggaatatggagcgctcgaccgccgaccaaatcgagcgctcacccgcagcgctccccgcttccatgtcgcccccgcccgaggcgggcgcactgtccaggtcggccatgtccttcacagggtcgaccacctgcaagtccaaacgggatggcgaagcgggtgcaacgacgtcggctggccggcagcctcccagaaaagcagccacccgctctactgggcggaccgtggccgacaggccgatcctttgagcgggccgcccggtcagcaggtccagacgctccaggctcaaggccaagtggactccgcgcttggaagcggcaagggcgtgaatctcgtcgatgatgacggttctgacgctggtcaggatcttgcgggccttggaggtgagcagcaggtagagggattcgggggtggtgaccaggatgtccggcggatgggccgcgatggctcgtcgtcccttggtatctgtgtcgcctgagcgcacagccacgctgaccgtaggcgcctccagaccctcctcctggtaggccgcggcgatgccggcgagcggtgtctccagattgcgcgccacatccgcgcccagagctttcagaggcgagatgtaaaggacgctcacgcccggtttgtctttgaccgccgccgcctcgccggctggcggccgcctcatgagctggtcaatggcccaaaggaaggcggccagggtcttcccagaaccggtcggcgccacaatcagcgagttcgcgcccgagcggatggccggccaagcagcctcctgggcgggcgtgggctggccaaaggcgtggaggaaccaggattgggtctgcggtgagaaagcggccagggccttgttcaactcgctcatctttaccctcccctcacgctcgcacccggtagcaggccagccgcgagtggtccatgagccgacggtcaggtatcgatcttggtgcgatcgaagtcgtctgcgttctcgacgatgaagcgcttgcgcggcggcacttcatcacccatcagcagggggaagatccgggccgcctgctcggcgtcctccatgcggatgcgccgcagcatccgggtgcgcgggtccatggtcgtgtcggccagctggtcggcgtccatctcccccaagcccttataacgctggatgtcttccttgtaggcgatcccctggcgttgcagctcggctaacttgccttccaactcatcgtccgagtaagtgtagaggtattcccccttgcgtttgccggccagtgagatgcggtgcaggggcggcacggcggcgtagacgtgaccctcctcgatcagcgggcgcatgtagcggtagaagagggtgagcaggaggatgcggatgtgggccccatccacgtcggcgtcggtcatcatgatcaccttgttgtaccgcgactgggagatgtcgaagttcgctcccgaaccggcgcccaccacctggatgatcgaagcgcattccttgttgcccagaatctgtgagatcgatgccttctgcacgttcaagatcttgccgcggataggcagcagggcttggaaggcggagttgcgggcggcctttgccgtgcccagggccgaatcgccctccacgatgaaaagctcggcgatgtcgtcgttgccgggcatgcagtccgagagcttggaaggcatcgaggcggactccagcgcgttcttgcgccgggtcacttccttggtcttcctggcctggatgcgggcgtgcatctcgccgacgatcttctccatgacccggccggcctgctccttgaacccgcgcttggagccggagatcatctgaccgaactggtcgtcggtcatcctggtcacaactggcttgacttgggccgtgcccaagacatccttggtctgcccctggaactgcggctcggcgatgcgcacggtgaccacggcgaccagtccggccagcacgtcgtctcgctcgatcttggcgtgcgggtctttcagattgaccttgagcttgcgggcgttggcctccatgaccttgcgcacctgccgggtcatcgcgttcatgaaaccatccacgtgcatgccgccgccgggggtggcgaccacgttgacgaatgagcggatggtggagtcgtagtcgttgacccagcgcagggcgatatccaccccgcaggcccgctcgatccgttcggcgtggagctccccgttcggcccgaccttctgggtctcctcctggtatgagccctcgccatggatgcgccaaatgtcactgaccggctcgccgttggaaaggtagtccacgaaatcgaccacgccgcctgtgtggaggaactcctccacccgcttatggcctgcggggttcacgggtcgcagctcgaccccggcttccggcaggtcccgcccaagcgggggctcacccgactcgtcctggttcggcgcaggttcagctccagcgaaggttgcgtcctcagcctcatcaactgattcggccgcctcggcttgaggcccagccgcctgttcctggacagcctgggagtcttcgcccgctggagccacaggctggtcgacctccagcagctcgtccctgctagggtcccccgtctcctggatgttctcatcgatgacagtgatcttgagccctggcaccaggaagctggtctgccgcacacggtcgatcagctgctggtagctgaattcggcggtgctgttgaaaatctccgggtccgcccagtagcggatacgggttccggtccgcttgggcggtaccttgcccacgacgcgcagctgggtgggcctgccctttcgggtgcgtttgaagggggaatcaggcgaagggcgctggccatcctcctccgtgtacacccccggatgtccctggtggaactccatccggtaggtcttgccgccgcggtcgacttccacatccagccgggagcttagggcgttcaccactgatgagcccacgccatgcaaaccgccaaccgccgtgtaggaggcgttgccgaacttggcgccggcatgcagtttggtcagcaccacctccactccggacagaccggtcttacgctccacatcgacagggatgccgcggccattgtcggccacttcgatcgacccatcgtcgtggagcgtaactgtgatctcgtcgcaggccccggccagcgcctcgtccaccgagttgtcgatgatctcccagagacaatgcatgaggccttggctgtcggtcgtgccgatgtacatacccggccgtttgcgtaccgcgtccaagccctccagcacggtcagagaatccgcgctgtaggcttcttcctgcgctttcgcggctttggtgtcccgtcctgcctgtgacataaccctcttcgctgtaatccctgtcctctcctatacgccgaccgcctagatcactggtccaggaagtcacgcaaggtctgcgaacgcgaggggtggcgcagtttggacatggtcttggattcgatctgacggatgcgttcgcgcgtgaccccgtagacccggccgatatcatccagggtcttaggctgaccgtcctccaggccgtagcgcattttaatcacgccggcctcacgcgggctcaaggtctccagcacctgtttgaactgctcctggagcaaagagaaggccacggcgtccgaaggcgcgatggcgtccgtatcctcaatcaggtcgccgaactcggaatcaccgtcctcgcccagaggggtgtgcagggagatgggctcacggccgtacttctggacctcttggaccttttcgaccggcatgtccaactcacgggccaactcgtcgggcgtgggctcacggcccaggtcctgcagcatctgccgctggacccgggaaagcttgttgatgacctcgaccatgtggacgggcacgcggatggtgcgcgcctggtccgccatggctcgggtgatggcctggcgaatccaccaggtggcgtaggtggagaacttgtatcccttggtgtagtcgaacttctccacggcgcggatcagtcctaagttgccctcctgaatcaggtccaggaagagcattccacggcctgtgtagcgcttggccagggagaccaccagacgcaggttggcctccaacaggtggtccttggccttcttgccgtcgttggcggcccacttgagctcgcgcttacgcttgaaggtcatatcctcgccttcggtgtccaagaggtgctgggcgtacaggccagcctcgatccgctcggagaggtccacctcctgttcggcgttcagcagcgagacgcggccaatctgcttcaagtaatccttgactgggtccgcggtggccccggcggtgacaacgcgacgcttgggattgccggagggggtcacgttctcgtcatcgtcggagtcggagaccacgaaagcgcccttgatgtcaggaggcgtgaccactggcttggggctctcctcctcgtcctcattgccgtcaacttcgccgtccggctcttcgtcctcgacctggtcctcttggccctcttccaaatcgtcgatgtcaagctcctggtcctcttccagctcctctggcgccttgtcctccagggcttcgtcgtgttcgctggattttgaggccttggtcttaaccgtggctttagtggtggtcttggaggatcgagccttgctggaggaggcggctgatttggatgagcctttggccttccgagtggaggaggacgaagacttggccccacccttgctagggaccttgcgggccttggtcttcgcgggagcagccacctgaccggactcctcctgcccgctacgctcgctatcgccggatgtcgtgtccttcgtggccaacttattcctcctgaacattcccgctcatcccaccgcccgcgctgaggcgcacttcaggcaagggcaaatcgtcaactactacagtgaaccatttcaaccggacgattattcccgcctcgccaggactgttccaccatccggactttaacgacccctaccctgcccaagccggacgcacttgatggcggagggccgccaggatgatcgaggccagcgtgcaaccctcgtccaagctcaaggccctcagcgcgcagtccatggcgtcgcccctccccatccaccacatcacataggccatgatcgctaggggctgcacttggaaggcgcccggcagccctcgcgccatctgatcaagcatgaccagcccggcctgacagcgggggcggtcgggacggacggctggatcagtgaaggctgaatccaggcaacggcacaggaagcgcacgctctcatccagatcaggccttgcgcacaggttaatcaaatcggacccctccaaccgggagcgagggcagagcatggagatgacgatagcgtcgcggatggtcatggtctgcgcgatggcgaccccgatgtccatcatcgaggcaacgtccagactggctttttcgggaggagcctgcccgagcccgtccacccagacgcgcaggggccgctccatccagcgccggtcagcctcctgcacaccccgttcgcgccgttcacgccggtaacgccccaggagctggctcatcctctcttccatcccgcactggtccgcgctcgcctgaattccctgactcgctgcatccataactcgccgcctttcatgacgctagccaccgactcgaccaggctccataggcccggccgtccgctccgcccagcttggcacgcggcgacatgtcctccctaaccgccagaccaatgtggtcgaatgtggctaaccagtctcgtcccttcccctggggccacccttgccgttaggctcagtggcatgacagacgagcgaatggcgcgaaaagtcactgaacgtgcgctagacctggtctcgggctttcttgacgcctgggcggggcggagttccggcttgccccggcaggccatcgagagggtgcgccgccaggctttgcgctccagccatggcggcaagcgtctgcgggccttgctcctcctggacacctgccaagctgttgcggcgtccacagcggatgcggaccgcttggagcgaccggtcctggacctagcctgcgcgctggagctcttccagacctccgtccttgtccacgacgatttgattgaccaagccgacctgcgacgaggtcagccatccgcgcaggtagcgctgaacgaggactggtcggggctgaccggggacatgggctcgaacgggcggcgcgccggctcctccctggccctgctcatgggtgacctgctcgcggcggccgcgagcgccagcgctgaccaagcttgcgaaagtctgccccacccacacgcttgccggcaaactttcctcgccatggaggggcaggtggaccaagggcaggtcatggacctggctatggagtcgctgccgttggaagacccggggagcctgcgtgaggccgccctggcgaccatagaggccaagaccgcctcctacacaacggtcgcccccctccagctaggcctccttgccgccggccgcgagcccgaattgtcccggagcttggcccggaagctgggcgtcggcctgggcgtggccttccagttggccgatgacctgctcgatgtgaccgaaccctccgccgcttccggcaaacccgcctgcggggacatccgcgaggggaagcgcaccgttctgctggcagatgccctcgaatcggccagcgacggtgagcggtcccgcctgtgcgatatctaccaggctccggcccgaagccaggaggacgtgcgatgggcggctgacctcttccgctccagcggggcgatcgaccgtgccagtgagcgcattgccacgctcagggccgaggcagggcaagccctgagcgattttaatgcggttttgaaccttgacgaggccagcggtcgggtgctggccaaggcctgtgaccgatttttgccctaagcgcccctggtcgctgccaagaccaggcgctagcataaaggacagggcctgaacgcgggcctggcctcgttcggggcccagggccgcccagggtggatttttcgccaagaagaggtcctagaacgctccacgcatccaggaaggccatacgatacgactatgagtcaagcggcagaggcgaacacgggtcgaatcatcgaaggccgataccgcatcattggcaaaatcgccgagggcggcatggccacggtctatgaggccctggaccaacggctgaaccggcatgtagccgtcaaaatcatgcatgcccagctggctcaaggccttcaccgggcccagttcgaggagcgcttccgccgggaggcgacttcggcggcagcgatcgccaacccccatatcgtccaggtttacgacaccgggcaagtggacggcctggactacctggtcatggagtacgtgcacggggtcaacctgcgctacgagatgaaccagcaaggcacgttcacgctgaaggagaccatccgcatcgtctccgaggtcttggatggtctggcctccgcccatgaggccggggtcgtgcaccgcgacatcaagccggagaacattctgatcaacgaccggggccacgtggagatcacggatttcggcctggccagggccgcctcccaggccaccctttcctccaccggcatgctcctgggcaccgcggcctacctgccgccggagacgatcgaacagaacctggccaccccgcaaggcgacctgtacgcggtggggatcgtggcttgggagatgctgaccggatcggtccccttcgtcagcgataacccggtgaccgtggtgttcaagcacgtccacgaggatgtgccacctctatcccaggtctgccccggcatcgacccggccgcgtccgctttcgtctcgaggcttttggcccgcaagcaggaggaccggcctgcggaggccagcgcggccctggctgagctcaaacaggatatggctggtttggacctggaagcctggcgttaccggttgatgccagccgatccgaccgaatcagcggacaaacctgcgctcgcgggcacgtcagtccgggcggcagcggcggagcctggcaccaccggcggagaggatcagcagggcgatcaggccgatgacctcttcgccgacgcggacgagcccacggtggccttcgacgaaggctcactcaggtcgggtacggatgaggatcccagcgcaacccgccggtacgccgcggcctcgccttcaaccaagcggcagaccgcgccgatgaccgcggtccaggagctgggcgagatggacagcaaacccacccatcggcgcggccgttgggtcgccatcgtcgtcatcgtcatcctggccctgttggccgcctgcggtggcggcggcgcatggtggtacttccgcggccccgggtcctactggaagctcccccgccccaatgatgtctcctgccaggagggccagccatgctcgatcaagggcgccgacgccgcccactacgagcagacccttaaggtagccggcatcccttacacgatcaagaatgatttttcggacactgtgcctcagggccatgtcatcgatgccaatccgggccaggcggacgacaaggtgagcaagcgcgggggcgaagtcagcctgatcgtctcgcgcggggtaaagatggcaaccattccccaagacatccttgtcccatcctcacaggttggcgcgcaccctttggaagcactgaaacaggcgggcttcagccagatcaaccaccaggatgccaatgacgagtactcgatggacgtgcccgaaggcgcggccctgagggtggacccggcccctggaagcacgaccaagcacaacgaaaccgtcagcatcacgctctccaagggacgtatgccggtgaccatgcccaccgtggtcggcaagaaccgggatgatgccagccaggccctgaacgagctcagactcaagacgaactattcggagcagtggtcggacaccatcgcctccgggcagatcatctccgcctcccacaacgcgggtgacttcctgcactggggcgatcaagttgacctcgtggtctcgaagggcccgcagatggtgaccctgcccgacttgcgcggcaaaaacgagaatgatgccagcaaggccttgaaagatctcgggctggaggtcaatatctcggcccccctaggcgacctgtcgcacacggtccgactgcagagtccggggcctggcgagcaggtgcgcctgcatggcactgacggcaagcccaccgtcatcaccctcaccgtggtctgaggcacgctcgtaggccaaccccggccccaggcgaatgtgtcagcggacatgcgcccgtgcgcggcacctcccgcactggcaggtggcggagcgacctcagttggacggaatcctcttcttgaccacttgggcgtagatgtccacgtactcctgcccactcatccggtcgatctcatgcatgacctggtcggtcagcctcctgatctcctcgtgggtcagctggttgaccgattcgcgaggcacgcggatggggcgtccgaaaatcaccgtggtcttaccccggctgggcagggtcttgccgggccgttgaagctccctagtgccgatcagggcggcaggcacaatcacggcgccggtctcgaaggccaggcgcgctacgccggtgtgcccccggtagaggcgaccatcagggctgcgggtaccctcagggtggatgccgaaaatatgcccttgctcaaggatcccgcgcgccctctccagtgcgcccaacgacttggaaccgcccgagcggtccaccgggaaaacgcccaccgagctgaaccaccacttcttgaagcggcctttcagacccctgcctgtaaagtactcggacttggccatgaagtgaatcatccgtgggcaagccaccggcaggaggccatcatcgatgacggccaggtggttggatgcgatgatgaccggtcctgacttgggaatgttctccacaccgcgtacatccggatggagccatgcgcgggccaggggacctaagagcctgacgaagaaccaataatgcacaaagcctcccttgtcggccagtcagggtggcggatgacttccgccgcggttactcttgggtatatgacccagcacaaggatagcaacggcgatgacaagcccaaaacgccttccgggattcaccgcggcggtgacggtcgaaccggcgacgactggcaggatttcctggcggctcacagcgaggatttgggcgacgtggaagcttcctcaacggcccgcaagttcgagcgcaaggcgcgtaaggctgacaagcaggcagccctgaaagcctcggatttggaccgttcggcctttgttgacagtggcccaggcgcaggacgcggcccgcgcgacttctcctccagctggctggatgtggatgaggtcatggaccagagctccgatttcattccgccgaacccggacttaggcgcccccaaggcgactggcatcctttacacggttctcaccctgataggggtcctgggcctggccgcctccctcttcctgccccatccgccgtccgtcctagggcctgttttcggactgtgcaccctgatcggcatagctgggctaatcgcggggcgtcgggacttccgccagcgtcgcgctccggatgatgacggagcccgggtctgagcccgataaggcgtacgaataaagcaggtcccctccggtttcgctggaggggacctgctggtatcgaccgctaactagcgagctgctttactgctcgttctgcccgtggcacatcttgtacttacgcccggagccacaggggcaaggagcgttgcgcgaggtgccggggaaggtgcgcccgtcggcccagggcgtgtgctcttcctcagccttaggccgcttgctggcggggaccgcttgctcggcgtggctcagaggggcagggcccacgggaccagccgcttcctcgctatcctcgccctcaccgtgctcctgacggtcctggtcggccgcagtggcccgttcatcggcgtcgtcatcaacagcgtccgggtctgccggggactcgtaattgatgtcctcgctatcctcttggtcagactcgttggactcttgctggcgttgagcttcggccatcgcacgctcggattcggctacctggcccaaatccacgttgtaaagaagctggacggactcctccttgatcgcgtcgatcatggagttgtacatctggaagccctcgcgctggtactcgaccagggggtcgcgctggcccatgccgcgcaggccgatgccgtccttcaggtagtccatctcgtagaggtgctctcgccacttctggtccaggacggaaaggacgaccctgcgctccagctgccgcatggagtcggcgcccagctcctcctcgcgcttggcgtaaagcccgtccgcctcctcgaccagctgatccagcagcttcttgacggccttatcgcccttgagcttacccaaggaatccttggcatcgtcctcattcaagctaatcccgcacaggccgcccagggcttcgctcatccccttccaatcccagtccgcgggcttgtcggagccgttctgggcaccgtggatgtaggagccgatcgtgtcggcgatgaagcggtggatgtcatcgctgatgtcctcgccctggagcacggcctgacgctcggcgtagatgaccttacgctgcttgttcatcacgtcgtcgtacttgagcacgttcttgcgaatctcgtagttgcgagactccaccgacttctgagcgttgcgcacgcccttggagacggacttggactcgatcggctcaccctcaggcatacccttggacatgactcgcgccaccagctgggtgttgaacaggcgcatcaagtcgtcttccagcgacaggtagaagcgggactcgcccgggtcgccctgacggcctgaacgaccgcgcagctggttgtcgatccggcgggactcgtggcgttcggtgcccagcacgtacaggccaccgagcccgacgacctcctcatgctcgtccttgacctgctccctgacggcctccaaggtctcgggccagagcttctcatactcttcgggcgtgtcgtccggggagtaaccctgctccttgagcttggcatcagccaggaactccacgttgccgcccagcatgatgtcggtgcctcgccctgccatgttcgtggcgacggtgacggcgcccttgcggcctgcgacagccacgaccccggcctctttcgcatgctgcttagcgttgaggacctggtggtcaatgccagccacgtccagcagggaggaaacgacctcggaggactcgaccgaggcggtgcccagcagaatcggttgccccttggcgtgacgcttggccacatccttgacgatggcggccagcttctccttcttagtccggtaaatcaaatcgtcctgatccttgcgaaccatgggcttattggtcggaatgggaagcacgcccagcttgtaggtgttcatgaactcggcggcctcggtctcggccgtaccggtcatgcccgccagcttgtcgtacatgcggaagtagttctgcaaggtgatggtggcgaaggtctggttctcggccttgacctccacaccctccttggcctcaatggcctgatggaggccttcgttgtagcggcggccgtgcaggaggcgacccgtatgctcatcgacgatcaggacctcgccgccttggaccacgtaatcgcggtccttcaggaaaagctccttcgccttgatggcgttgttaaggtagccgatcagggcggtgttgccaggctcatacaggttatcgatgcccaggtagtcctcgaccttggtgatgcccgggtcgagaatgccgacgaccttcttcttctcgtcgacctcgtagtcctcgtcacgggtcagccggggaaccagcttggcgaactgccggtaccaacgggtcacgtcaccctcggccgggccagagatgatcagaggggtacgggcctcatcaatcaggatggagtccacctcatcgacgatcgcgtagtggtggccgcgctggaccagctcggccttgtcccaggccatgttatcgcgaaggtagtcgaagccgaactcgttgttggtgccgtaagtgatgtcggcctcgtactgcttgcggcgttcagcgggcttctggtccgtgatgatgcaaccgaccttcatgcccaggaagcggaagatgcggcccataagctcggactggtaggaggccaggtaatcattgacggtgaccacgtgcacgccttcgccggacaaggcgttcagataggcgggcagggtggcgaccaaggtcttgccctcaccggtcttcatctcggcgatattgccccagtgcagggcggcgccgcccataagctgcacatcgaagtgccgctggcccagggtgcgcttggagacctcacgcactgtggcgaaagcctggggcatcaggtcgtccagcttttcgcccctgtccaggcgctctctgaacttggcggtctggcccttgagttcctcgtcactcaaggcggagatctcatcctccaaagcgttggtcgccttcgccacgccctcaagcttgcgaagctggtgcccctcgcccatgcgtaggactttgtccaagactgctaccacgttgcgctccctatggttcttcccaacaatacccaggacctgcctgattcaccccaggtcagaccaaagccgtccccatcttacgcgacgaggcggattttctcgactggccggcggtgggtccagctctcggccccgaacgcatgcggcttccaaccagaccatcccgggctgaccccgatgacgccgaggccttcatgactattcggatgccagcccggtcgtgagctggcccatgcgcgattggcgcgtatgcgaagcgcccaagcgggcttgcccgcctgggcgccgtgaatgcgaggcccagcggaatgccccgctgatcctgctcagtcgttactttttgccgccggctacgttctcgggggtgtcaatctcgaagacgccgtaggaccagccgtgacggtggtagaccactgagggtcggcctgtctccttgttgacgaagaggaagaagtcatgaccaatcaactccatctcgtacagggcctcgtcaatcgacatgggctcggcaatgtggagcttgcgacggatcacgattggagtgtcgcccacctggacttcgaccgactcccccgggcccaagtcggaagccatagcgtcctgttgggctgagttatcggggttaggggcctcggccggctcctggggctgctcgacttcaacctccatcggcagtggcgcgtgttccaggccacgacggtggtccttgcggcgatcgcgggtgcggcgcaagcgcagggtgagcttatccaaggccctgtccagggccgcgaattcatcggctgaggatgcttcagccctgactacggtcttgccggcgattactgtcagctccacgcgcttggcggaatcagcctgccgggggttgccctcatgggtcagtacgacctggacgcgctgggcgtcgggggcgatagcggtcacacgattcatcttgctttcgacgacgtcacggaacttctgcttgatctgcgtatggcgtccggtaatgacgatgtccatgtggacctccttgcatcaaggaacgggacgggcccgttgcggggaccggtgatgctgccacacatcccggcttaccccgattgtagccgatgaaacctgccggccgcaggcaggacccccgcttgatgacacgcggtcacgccccatcggctatgctgatggggcgtgaggtctctcgatggccgcggcggcttcctggccgctgaggaacttccgggctccacagagcacgatggcggataacgtccgcccagggtgacctgagagagagcgcaacagagagcagaccgcccaccgcaaggcgggtaagggtgaaagggcggtgtaagagaccaccgggctcctggtaacaggagtcgcatggcaagcctcatcgggagcaaggccaagcagaaggcatcaagggttgctcgccccgccttcgggtaggccgctggagcctggcggcgacgtcaggtcgagatggatggccatccgtcccttcggggacgacagaacccggggtatgaggggcctcacgcttcatctccccatgggcagcaagccccttacaggtcttcgttggtgaacaaatccgccgccacctggcggatggcttccgggctatggcccttgcgtccggcggcagcccaaagccgacgcttgcgtttttgcaagtccatgccctgggtcttgcaggccactttcctccccagctcataggccgaatcgatgaagaggccctgcctgacggccttcgccaccacctgctcagccagggggcgttccaggccttttctgaccatctcgcgtaccgccccgcgctcgccaaggtttcgttttaagcagtagcgcaggaagccctcggcgtaggcctcgtcatcgaccaggcccagctcttccaaccgactgaccgtcgtctcgatgacaagctcgtcgtaccccttgccagccaggcgttgggccaacgccttacgagggcgcgcggcggcgtccaaaagcgtcagagcggcctcacggcaggcgtcggcatccgcagggtcacgggggccatcaccggcggtcgctgagcctcgggcgccgaacccaccgcgttttggcaagcgttgagatcgccgtccatgcttgcctttcaatgaacgtccgccagcatggccgcccgcaggcacacctgcattgcggccatcctcagctgcactgacgccgaaatgcccaccgcccctcgccggaggcaacttgatttcacctgtccctgcacccctctggctacctgggcctgaagcgtcccggctgcgcgtggaggaaagcccggaaatagacgaatcagtcgcgtcgtcatcgggggcggcatcagaaccgccctgggtgggatcccccttcggctccgtgatcagttggggatgctccttaaggaaggccgccgcttcaatcacgattgaatcctcagaccgcctgggccgtcagaacaggggcactgggcgagccggcctcggtcggcgctttctcaatccccgatgcatcggcaaccgcagcaggctggtttccaccaccctgagcgtcggcgcccccatcttccgccttgggcttcaaaccaaaggcgatcttgaccttgtcttcgatctcctgggtcagccctgggttgtccttcaggaattggcggacgttctcccggccctgccccagttggtcgccctcgtaggtaaaccaggaaccggatttcttgatcacattggcttggagggccatgtcgatgaccgagccttccttggagatgccctccccgtagaggatgtcgaactcggcgatcttgaagggcggagccatcttattcttgaccaccttgaccttggtgcggttgcccacggcctcgtcaccgttcttcaaggtctgaatccgacggatgtccaggcgaaccgaagagtagaatttcagggccttgccaccggttgtggtctcggggctgccgaagaaaacgccgattttctcgcgcaactggttgatgaagatggcggtggtgttggcctgggagagcgctccggtcatcttgcgcagggcctggctcatcagtcgggcttgcaggccgacatggctgtcgcccatatcgccatcgatctcggccttgggcaccagggccgccaccgagtcaatcacgatcacgtccagggcgccggagcggatcaacatgtcggcgatttccagtgcctgctcgccgttatccggttgcgagacgatcagcgagtcggtgtccacgccgagcttgcgggcgtactccgggtccaacgcgtgctcggcgtcgatgaaggccgctaccccgccgttcttctgggcattggccaccgcatgcaaagccagggttgtcttaccggaggactccggtccgtaaatctcgacaatcctgcccctgggcaggccaccgatgcccaaagccatatccagagccagggaaccagtggggatcacttccacgtcttggaccggcttgtcgcccagacgcatggctgatcccttgccgaaattcttctccacctgcgccagagccgtgtccagggccgccttgcgccgcggatccatgccgtcgacatcctcgactttggacttggacttggctttgctgttggtctgatgtgccatctggctctccttcatcaatcgtttcgtcaggcccaccctaaacgaaggctcgaccccatggccagctgttcgcgcaatgtggtcgaacgtgatcaacccccgccgccggcgcttggccacccctcgtgacagctaccagcatacccgaagatgcgaacaaatgttcgaaatgacctcaggcggccggcaggggcggcgcgttatggtccttgccccaacgctggggatcggggacctccatctggtcgcacaggacgttccagacgacccggggttccacacccgcctccagggcctcgtaaaccgtcatggaatccaacgccgccaggcgctggtcctcggctaaactccgcccgtagacgcggccgaagacctcctccagcaaggtccagaattcacgttccctcactgcacctccctttcacccttaagcacgaacacggcggggcatccggctctcaagaaccgcacgccccgccgcagtcatcggcgcccgaccgcgccatcagccctgatgggtctccaggtaatcggccaccagacgcaaggtctggggcacacccaacccgagggcctcagcgatagagctcaacaactccgagctggcttccttttgcccacgctcgacctcggagaggtagccgagcgagacgccggccttctcactgacctcacgcagggtcttgtggtcattggtacgcagctcgcgcagcacatggcccagagcctgccggagcgaaaccccctggccctcacgctgatcatcctgcccctgcgcttcgtcctgctggctggcgctcacaccatcttcttgcatccacatcttgctcagactcgcctgacgctcttcctttgccttcttggccgccttggcccgcagcacttgctgctgagcgaaggcgacggcgcgccgctgcgctggcgtcaaatcccgcacgcgagcgttcctgtcctgggtgggagccgtggcactcagcttgaacctgtcctcggacctggtcaacacggtctctgccttgttcatagcatcccctttcgcctgtggtgtattcatcatcaccaggcacaaacgatagggacagggaattattcccagcatgaaacccaggggcttgccctgtgacctatctcacggatgcgcccaaggactgcgccaaacgaaagagcacttgcgaaacggtgcctcgccggacctcctgccgggagcccgtcaagcgcagctcgaaggagcgcaggtggtagccgtccacaaccaggccagcggcctgcgactggggcaggaagccaatgggcagggccaacgctatgtagacaaggccggcgggctggtcgccatcggggccaggaccggccacgccggtcgtggccatgccgaccacccgtccttcacgccccggctgtgtgtaaaccttggcggcgcccagggccatctgctcagcgaccttggggtggaccgcaccgtgcgcagccagcaaggccgaatccacgcccagaatggaggccttggcctctatgtcgtaagtgaccgccgagcccaaaaagacatccgaggcgccaggcacactcacaaaggcatcggccagcaaacccccggtcagcgactccgcgccagccaggaagagcccggccctcctacaggcattgagaacctcggtcgccaaaccctcctgctgctcactcatcgccgacctcccgtcaggacgccatgcacatactcgaagcccgagtacaagcacagggccagggccaggagaatcactcccctggccgaaatcacataccagacgcccaagcggcccagcggggccaagagcaaggccagtccgacgcattcgaacaaggtcttgaacttcccaacctgggaggcggcgatgacctggccgcctgcgtcaatgacaaagaaacgcatgatggtgatgcccaactcccgaatcaggaagagggcggtgaccagccaccagatctcgccgaagaccgaagcgacgaccaaggccgaacagatgagcagcttgtcggcgatcgggtccatcaacttgcccagctcggtgacttggttgtacttgcgagccaggtacccgtcgagcttatcggtggaagccgccacgatgaacaggatggtggccgcccagcgccggcctacgccgcgctccccccaaggcccggcttggatgtcaacgataatgaagacgattacaagcgcgatgcgggcataagtcacgatattgggaggactgctccacccatcgagcaggctatgcctgcgcccgtccgtcttggaccgcgaatcatcccgcattacctctccttgagtgtctaccagcacatcctaccctaggcgcccgtccagaacgaaagccccgagcgaacaatcagccggcatccaccccctgcggctgcgcttggtcgattgacgcgctgtcgccgcgaatgaaagccagggcctcttggagctgcggcggctgaatgagcacctcccgggccttcgaaccctcggagggccccacgatcccccgcgactccagcagatccatcagacggccggcccgggcaaagccaacccgcagtttgcgctgaagcatggacgtggatccgaactgggtggtgatgaccaactccgcagcctgaaggagctcatccatatcatcgccgatgtcctcggctatctccttcttgcgctcctcgccctgggccatctgctcgatgtcttggcggtacttgggcttgcgctgggtgcgcacgaagtccacggccttgcggatctcggactcggagacccaggcgccctggacgcgggtgggcttggcttggcccatcggcaggaagagcgcgtcgccctgtccgatcagggtctcggcccccgtggcgtccagaatcacgcgcgagtcggtcgaggaggatgtcgcgaaagccaaccgggaggggatgttggccttgatcaaaccggtcaccacatcaaccgacggcctctgggtagccaggaccaggtggacgccggcggcgcgggccaactgggtgatgcgctggatggaggactccacgtcgtttttcgcgaccatcatgaggtcggccatctcgtccaccaccaccagcaggtaggggtagggcgccaccttgcgattggaaccggcgggggcatggaccttgcccgcacgaacagcttggttgaagtctttgacgtggcggaaaccgaagaattgaaggtcatcgtagcgggcgtccatctccttgaccacccattccagggcctgcgccgccttcttgggatcggtgatgatgggcgtgagcaggtggggaatgcccgcgtaggccgaaagctccacccgcttggggtcgacgaggatcagccgcacctgctcgggggtggcgcgcatgatcacggaggtgagcatggagttgacgaaggatgacttacctgacccggttgcgccggccactagtaggtggggcatcttggtcagatcggcggtcacgaagtggccttccacatccttgcccacggcggtcagcatggggttgtcgtcgccctgggcctcctgggagcgcagcacatcgcccaggtggacgatctcgcggtccacattagggatttcgatcccgatggccgacttgccagggatgggcgagaggatgcgcacatccgaggaggccaccgcgtacgcgatgttccgtcgtaaattggtgactttctccaccttcacgccaggcccaagctccacctcgtactgggtgaccgagggaccgcgcaggaagccgaccaccgtagcgtcgatgtcgaactggcggaaagtggactgaagggccttgatcaccgtgtcattagcctgggtccgggccgcatgaggcttgccccggaccagcaggtcggtcgaaggcaggacatagggggcctgaggttcatcctcctcctgacttccgctccccgtggccccagacgggctgtcagcccgctggccaccatcaacgccccccgcggccgattggtcgagctcacggaccgcttgcgccgcagcggcccaaggatccgctgcccctactccggacaactgggctggcgtgaccgtaggggccgcgggctcggccggaagggaactggtggcggcgtcctggaatcccgggaaagcgggacccgagccggccacagacgccggcatggcctcggcagcagtcgtgcttactggctccatgccggcacttgacccaggctccaggcggaccagatctgcctgcccttgtacctgtgccgccttgtcgaagggatcgtcggcctcgtagtggtccaggccgtcctgcccctggcccttacgaccccggtgcaggagacgggagagccacccccggcgcggcgaaggtccctgagccggcgtgtcgcccttcttctcgccttcaaggcggctgggaacgcccggcgtggaagccagcgtctcctgccccaccctcacctcgttggggaagagctcctggtcaccctcactctccgcttccttatccgcccgtctggcgccgaagcatgcggacaccggacgcaggaaggcatcaatgtggacctggaagatgagcaggagggagaacaaacccaccagggcgaagatgatcgtcgcgaaaacaggggaaagcccccaggccaaaggcgacccgacaacgaatcccagcaggcccccggagcggcgaatcgcatccaagtcgaagccgcgaatcgacgaaatcataacgatgtcaaggattgagcagaccgaccagagcaggaggatcaagccacccagcgagtggacattgcccgaacccttaccagagtgggcgatcagcctccagaaggcccagatcaacgcgaccggcaggatgaccgagggcaggcccagggcggcggaggcgacgaaatgcagcccacggcccagggcgccatccaccctgaaccattcggaggcgcagaagaggatggctgcgatcaggatcaggaagcacagaccatccctgctgtaggcggggtcgtaccgtgtatcgccggtcagggcccgcaccgccttgcccaaagctcggggcaaccacaggatggctttggtccagccggattccgcctcctcgtcctcctcttgggatgacgagggacgacggttccggccttgggccgaacccttggtcttgggatgcgattgggtctgttccctgcgcttgtctgaggcgttcattcgtgtcatagccttcccagactacccgcgatgggtcctccatggcgtgccatgggccctgcttgcacaaagaatcctaacgaggctgggccgccgtggccccctgagcacgcgacttcgctggctcgtcgcaaaccggggcctggcgcagggcacccttgcgctggcgggcgaaggaacgaatggcgttcacgacatcggtcccacggtccaggacctcctgggcgccttgcgggtcgccttggcccagagcctgccaatagtgggttttgacctgtacataacggcgcctgagttcgagctctgccatctcctggtccaactggcgggcctgctcggccaggagctcgacttgctcgccggcacgttgagccccctggctccggttcgccaggtactcgcgcatccggctcaggggcatccccgtcacgttcaggcaggagattgccagcagcaggtccaggtcctcgtcggagtacacgcggtgcccgctgctcggatcgcgctcgatcggtcccacaatgccaatcgactcgtagtagcgcagggtcgattcaggcaggcccgacatcagcgaagcctcacggatggtatgagaggtcggcgccccggcaggcgcttcagcggcggcgaaagaggtcataatcggagtctataaaattcaagcacttgaagtcaaacgatgaaatcagggaacgccggccgccaagggcccaagcccgggactcgcgcctcgcagggttcaagcgccgtcgtgcgctaccagcgaacctaaggggtgtctgatgaccgaatcgtcggacccatcacgcttcgatccatcatccttgtcggctgccgcgaccacagccagggcccgctcaagcaggtcgggagccaaagcgtccaaccagtggacgcgcgggtcgcggccgaaccaacccatctgcttacgcgccaggcgacgggtcttgcgcgcgatcaagtcgaaggcatcatcctcgttgatcgccccatccaggaagtcctccacctgctggtagcccaaagcccgtgaggccgtcgcgcccaagcgggggcggagggcgcggacctcttcgatcagcccgccttggcgcatttgttccgtgcgctggccaatccttcggtccagagcctcccggtccacgtccagacccagctggaccgccgccagcaggtaacggtactggggcaagccggccgagtaggggcggcccgtgatctccataacttccagagcacgaatcgtgcgccgagcgttacgcgagtccatccgggcggctgccgctgggtcacgctcctccaactccttgaaaaggacgcccggcccctccttccgagcccgttcctccagcttgccgcgcacaaccggatcggtgccaggaaaagcgatgtcatcaatcgcggcccgcgcgtacagaccggagccgcctaccaaaatcgggcggatcccacgggcgcgaaaatcggcgatggcagcccgggccagggtctggaagcgggcggcggacatggcttcctcaggctcgatgatgtcaatcagatggtggggcacagccgcccgttcagcggcgctcggcttggcggttcccacatccatcccgcggtacatctgataggggtcggcgttgatgatctccgcccgttccccctgctcgcccagggcctgggccagccgcacggccaaggacgttttgcctgaagccgtcggcccgacgatcgagatgatgggtggcgccccgcccttttcgtcaatggctgagcgcataggcctgcccctggctcggatctgggtcagcggtcaaatagtgcttgccggcaccggtgatcgtgcaagccaccaaatcgcccacttccgggaccggttgcccttcaggcacgcccacgtggaccaagaccccaccgcgctcacgcccggtcacccggtgggtcataccatcacggcggccttgacgctgggcgatcatcacctccgcgcgccggccaacgaacgagtcgaggttcccctgggtgatgcgctcctgcagggccaggagccggtcgaaacgttcctggaccaccggcttgggcacctgctccatagcagccgccggcgtacccggtctgggcgaatactcgaagatgaaggccgaggagaacctggcccggcccatcaggtccatcgtcgcttggaaatcctcctcgctctcacctgggaaaccgacgatcacatcggtcgaaatctgagcgtccggcatggctcgccgaaccttgtccaaaatcgataggaagcgttcgctgcggtaggagcggcgcatggcccgcaaaatcctgtcggagccggactgcaggggcatgtgcagctggtgcatcacattgggcgtttcggccatcgcggcaatcacctcgtcggtgaacgcagccggatgaggggaggtgaaacgcacgcgctccaagccttcgacccctccacaggcgcgcaggagccgggaaaaggcatcgcgctggcccatcgagtatccataggaattaacgttctgccccaggagggtgacctccttggcccctgccgccacgcaacgctccacttcggcgaggacgtcgccgagcgggcggtccctctcccgcccgcgcacctgcggcacgatgcagaacgtgcaggtgttgttgcagcccaccgaaatcgccacccaggccgaagacttggacccgcggaccgcaggcaggtcggcgggaaatgcggataagcgatcggacacctggacctgtggacggtgctgcccccgggctcggtccaagagcccggggaggtcgccgatgttcttggtgccgaagaccgcatcgacccaaggcgccctccgggcgatacgctcgcggtccttctgcgccatgcaaccgccgacagcgatctgcgcctgcgggttggcttgcttcagacgggcccacttgccgatcgtgccatacatgcgtttgctggcattctccctgaccgcgcacgtgttgagcaccaggaggtccaagtccaaggcccgcgcctgttccagactggctggacggtagccctgggcttcgagcacgccggcgattcgctcggaatcgtgaacgttcatctgacagcctaatgtgcgcacgtagtagagccccttgccacgcggaccgtcgggttcctcagcgagcgccatcccacgctcggccggcgtcatcatgccttcatccatagtggccgattctacagccagacctttgccagctgattcgcaggctaagacgtgggccggttgcataatgggatgagctggtccacggtcgccgtcggcgagccgggccggccccgcacgatctgggaggcgaatgtgatacttgaacgcggcagcgcgatcaacacatccgaactacggcagcgtctggctgcgctcgacgaggagcataaagcgcagctaacgactgacgacatcatcgaattcgtggacctgatgcaggtctacgagggcgccatgcgggagatttccaccaagttggaggtcctggactcggagttccaagtccagttctcccacaacccgatccaccacatggagcgccgtctgaagtcccccaactcgctgatcggcaagttggagcgccggcagctgcccatcaccgtggaatcggtgcgcgaccatattttcgacgtggcaggcgtacgcgtcatctgcaactaccgggacgatgtgtactccgtctcgcgctacctgtccgatcagtccgacatccaggtcctcagggtcaaggactacattcgcggccccaagcagaacggctaccgaagcctgcatattatttacgcggtcccggtctttctgacctcaggcccccactacacgccggtcgaagtgcaattccgcacgatcgcgatggactactgggccagtttggagcaccagctacgctataagtccgacctgcccgactcccgtctggccgagcactcgcagaccctgctggactgcgcccgctccctgcagaacatcgaagtgcagatgcagtccatccaccgcgacatatccggttccccccaggagcaggagggcgatgacgagcgcctggagcgtttgcggtcagaggggaaggaacagcgccgggccgcaacggagtgagggcctgacgcgataaccgggatcagccccataccgagaccaagtcgggccggcctcacgaagcgcggtggggcgcggggagaccggcccgaccccgtcctgcatgaatcagaagtcgaagtggtccgggtccgcgcctacgcgctgaccggtgtccatgcttgacacggcctgcatgtcctcatcggagagctggaaatcgaagacatcgaagttgctctcgatccgctcttggtgaacggacttggggatgacgatgacaccccgctgcaggtgccaccggatgaccacctgggccggggacttgctgtatttcgccgcaatcgaaaccagcctcgggtcctccagcaggtgggtgccggtgccgcctagcgggctccacgcctcaacgtcaacgcgccattcaccgttcgcgtagtcgatcagctcctggttgacgaatatcggcgaggactcgatctggtcgaccgctggtttgacatcgctgattgagcgaagctcctccaaatggtgctgttggaagttgcatacgccgatggcccgcacgcgccgctgcaggtagagctcctgcatgtcctcccatgcctgctgccaaccttcggccggccaatgaatcaggtagaggtcgatcatgtcgacccctaaacggtccaggctctcctcataggcctgcttggcccggcccgcccgcacgtcctcgttccacagcttagtggtcaggaagacctcgcgccgtttaagtccggattcgcgcagcccttggcccaccgaagcctcattcccgtagattttcgccgtgtcgatatgccggtagccggcctggagggcccagcgcacggcgttggcggtctgctccccctcgggcgtctggaagacccccaacccaagctgcggaatcggcaccccattgttcagcgttatcattggctgttcgttgctttcgctcatcgccatgctcctcgtcttcctcgctgtcgacgccggtatcggccttccctgccatcgtatgccatgagcccgtaccccgccagggacccgatgttcggtggcagcgcattcccaggcgtcagtaaggattcgccactaagcttgagctcgcaggcggcgccctccgcgccgcatccgtttttgaaggaggagcccatgacattcggtcgacagcctcaaaactctgatcaggcctatcagggccagccctaccccacccaagagccctaccagaaccagggccagcagccatacttccagcaaaacatgcagggtcagccttacgggtcccagtacgtacgccagccggacgggagcgcggccatcctgaccgagcctacgtattcatacgagcgcgcggagcataactcgatgaccaaggcatacgcgcaaatggccgtgggcctgctggtcactgcggctgtggcctacctgacctacgcctcaggcctgctgtacagcttcgtatacgccaccggcagtctcggctgggtggctttgtgcgtcgcccaggtggcgttcgcctgggttctgtccgcccgtgtcatgcggatgaagccatcgaccggcagggtcatgttctactcatacgccgccctcatggggctgaccctgagttccttgttcgccacctactcggtacccacgcttttagtcaccctcgtgtcttgctcggctttcttcttcgtcctgaccatgctgggcctgaccacccgtaagaacatgctgggttgggggccagccctgttcgctgggctgatctccctcctgctggtgcaggtcgtcctgatgttcatcgcgccttcgaacacggccttgaaggtgatcgccgccttgggcatcgctctattcgccgcgctcacgattcacgacgcccagcagacacgggctatcttctcggcctatgagaaccaagggacgcagatggtggaacgggtatcgatcctgtgcgccctgaacctctacctggacttcgtcaacctcttcctttacatcctccagctcttcagctccaagaactgagcgctgcacaaacagaggatataaggctgagcccgtaacccaggcatcccgctagggatacgggctcagccgttacctgggctggtttgccgggatcacaatttgagtactttatccaggtatttaggcaggaaccctacggacagggccatagcggcgcaccccacgatcaaccccacgagcgtagcggccgccgaccggcccgaggggatcacgatcgcgaagaagcgtgccaccagggagatgaaggcgccgatgacgcctgctgccgcgaagagggcgaccaggacccccctccaggagttgagcggctgggccaccctggccagcacaaggatgcccatcgcgaacaggacaatcgcgcagaccgtacgcagttgggagaggtcgctcgggatggacagactccaacccatcgcagggggcaaggaccaggccatagccagcactacgagcgccgtggcgatgccgccgggcagggcgaaggcgaccacccgcttgagaaagcccggcttatagcgacgggtgttgggtgccagagccaagaagaaggccggcatgccaatggtcaaggcgccgatgtacgtaatgtgcctgggcaggtaggggaaggggatggcggtcagtaccacgcccagtgaaatcagggcagagtagacggtcttgaccaggaacagcccggcaacccgctccatattggccatgacctgccggccccgggccactacatcgggcaggtgggagaacttggaatccaccagcaccacctgcgccacggctttagtggcaggggccgcattgcccatggctatccccaggtccgcctccttcagggccagggaatcgttcaccccgtcgccggtcatggccacggtgcgcccacccaggtgcagggcctggacgatggccttcttctggtcgggcagcacccggcccagcacgtccacatcctccaagacccgggccagctgggccgtatcggagggcagctcacgggcgtccatggccttaggcgggcgatctccagtcagtttcaccttgcctgcgatcgctgcgaccgtggcggggttgtcaccggagatgatccggcagcgcaccccctgctcacggaaccaggtcaaggtaggctcagcgtcctcacgaatgctttcggaacaggtgatcagggccgctggccgcaggtcctgcggcaggcccgagtcctccaaggagggggttggctcctgcgccccactctcgcgtgaagccagcatcagcacccgcaacccttgatcggccagcgcccgaaccgccgcctccaccagtgggtattcgcccttctgtgaggccaacaagacttcaggcgcgccgaagtaccagcttggcccttccttccaggccaccgccgaccacttgcgggctgaggagaaaggcacccgctcccccacctggtccgagagccggtacgacgaaaggccctggagaatggccgaaccggtggcgttgggattctcctcctgggccacgtccacgagggcttgctccaactcctgctgacgccccatcggcggtgcttgcaacccttggtcctcgcccagcacggtcagggaatcgtacacgataccgccgtcggtgattgtgcctgtcttgtcaaggttgagcgcatcaacccgagctagggtctcgactgattccagctcctggaccagggtgttctgacgggccaggcggatggcggccagggcgaagttcagggaagtcagcaggacgagcccttcggggatcatgccgaccacgcccgccacggctgagaccacggcccctcgccaggcgccggtcgtcatggcctcttggaagcctccgaccgtgcgcatctgggtccagaccaagaggatgcacaggggcaccacgacgacggtcatggccttgaggattgtgttgattccttcattcaggtcggaatgggtcttcttgtaaaccttggcctgagcggtcagtttagccgcatacgatgaggttccgaccgcactgacttctgtcagggccaagccggagacggccgtcgaacccgaataggcctgctctccctccgatttgcgcacggtgcgcgactcgccagtcagcatcgactcgtcaagctccaggccccatgtcttcacgatccgggtgtcggcgggcacctgatcgccggagcgcacccacagaaggtcgccgaccaccagtgagtcgtgcggcacgctcacattccggccgccccgatgagcgtagtagtcggaagccaccaaaatggagagcttgtccaaggtccgcttggccttgagctctgtggccacaccgatgccagtgttgatgatgatcacgaccccaaagaccgcgtccctccactgtccggtcgccaggaccacgatcatggccgccaggatgatcccattgaagagggtgaatacgttggagcgtatgatttgcccgagcgtccgcgacgaatggtcttcggagacgttaacttgtcctgcagcggttcgttcgtcaacctcgctctggctcaggccaggcaggtccacctgagggaaagagggtgtgggtccttgcgctacgctcactgcttcgcctccatctgatccggcgatgtgcgctgggtcggttcatcattcaagtttgccacaagccgacgggcatgctggcggtcatccgctatggtctgcaggacgctgggcagtggccgcgcgctgggtgagccctcatcgatatccacccgcgccgcgtatagggtggtgtccccgggctcctgtccgccgtcgaggacgacgaccgggactcctttgtttctggccagaatcaggctccgggaccaatcccccgcccctggccgctcaaccgcaatcagggagaccctgcgagcgaccgcatcgcgcactccctgctcctgacctgcctgatcccaggccggtgcgtagtatgcgtgcatcccggccctctccagcgattggaagagcctgcggctcaggtcctgccagcgcgaatcccgctccgcgttggcagggccgattacggccaccagcacggccgaacgatccggcccgtcatgctcagcgctcaccccctgccgccagctgtcgccgacggctcggtcacgcggcgcgcaacctgcgaggccccccagcagggctaaggagcagaggagggccagagctgggcgaaagagcccactgaacccatccaacctgtcgcgcttgctcatgagccgtcattttagccaggtcatgtaacgctggtgagctcaccgggtgaagacagccagggtctccacatggtgggtcatcgggtacaggtcgtaagcctggatggaggcgagctggtagcccgcagcggtcaaggtggccgtgtccctggccagactggtcgggtcgcaagccacgtagacgaccagaggggcgccgctgtccgcgatgagccggcaaacggccgccttggctccagctcgcggaggatcgagcacgactgcatccggccgctcgaacccttggggaatcctgcccgtgatcctcttggccacatcgccggccagggcttcgattcggctgtccaagcctgcccgctgcgcgttatacctggcttgggctaccgccacacgtgatccctcgaccgcgagaacgcggccatgttcaccggccatggtcgccaggggcaggctgaagagcccggaacccgaatacaggtcccagatgacctgggccgactgagcctgcaacccaccttgcacagcgcgcagcaccgcgtcagccagcagggccggcgcctgtcggtgaatctgccagaatccagcggcatccacctcataggtgaaatcgcggccttgaacttcgacgtgctcctcaagtttgcgacggcctgccttgaccttgtcatccaccagtaaagcgtagttcccgtcctgaccgtcacgctcatgctggggcaaggccagccgaatcgacgaacccggttcgaatccgccccgccatacgcccagctgggtggccaaatcgttgagctcgatccgtgccaaaggcatcgcgtctatcgccacgcgctcatgggattcccgccgcctcatggagggcttgccctgctcatcggcgatcaggtcaatcctggtgcgccagtgcaggccgccagcctcctcatctccgggtgcgcggaccacttcgaccgaggcgtccacatgacccatccgctgcatctgctgctcaatcaagcttcgtttccaagccaattgggcaggcaggccggcgtgcaccaagtcggcaccgccaacgcccccttcctgggccagcggcccggcgagcggccaagcgggggtcacgcgatccgggctggcctcaatcactcgggtcacctcgccggtcagaaagcgcgccttggctctaaccggttgatcaacactgacttcaaccagctcacccggcagggcgaagcgcaggaagatgacgcgcccgtccaggtggcccacgcaccgaccctgatccgcgtaacgttcgactcgaacggtttccggcatgaaagcactcccccactgcaacctatggctgcgtccaagcgggccttccgtcagcccgctgcgattatcgttcagccttaccggctgacctgatccggcttctcggtcgatcccgtctgcctctcttgccccgcttgccctgtccgttccgcttcctcagcgagtttgcgccgatggaaggggccggccaagagcagccaggtcagccatatgcccaaagcgaacaagggcaggcccatgaccaatctggccgtgcccagccaagccagtcgatggctcaggtagaggggcagctgcactgccaggcgcgccgcgaacaagaggagccacatgaggctggcaagccaatagcccttatagagctccgggtcccgccgccaagcattcagccactcccgccagccggccaggatcgggcgacggacgtattcgaccagcaagcccactcccggtgcccggcatgccatggtcaaagccagggccacgatccaagcgacattagtgatgaaaccgggtaaataatagctgcgggcatcgcggctcaaccaggcccaggccaagcagatgcccacggcgagcagtccggtcagggcgcccagccaggattggcgaaaaatcaggcgcagcgccagctggatcagagcaagcaggccggagaccaggacggtgactttgaggtcaccgctggtgatgaacagcagcaggaaaaccagaccaggcaggaccgattctacggctccccgccaaccgccaatcgcccgatagacgctgaagtcgtccgaggccaccgccgccaaacccgtccgcccaggctccttcactgtgtcagcgcacctccgagaacataggtccacgtgagagcgtggttttcacttccgtctgctggtccgagtcgaaaggtcccgtcggcttatcaggaatcttcgcctcgccttcgccggcaccttcatcctcagccttcgccgcggcacgctcggccggtgagaccggagcgtgcatgggaattctgtcgcgcggcgccaggggctcctcgcccctgtctacgaccacgtccatgaagtaacggtccaaggtctccttctccttgccgcctttagtggccgggccggaaaagatgccgcgcagcatccagcgtggcccatcgacacccacgaaccgggtcatcattcccttacccttgacggtcactgggaggaggagctcatggccgaagacgccttcgacctccttagcctgggaattcgccttcgccaggtcggaacgcatcaaatcccacaggcctagggtcttgggggcggcgaaggcttccagttcaaggcttgacttgccgaaggtcaccgtggcggctaggatctcgccggactctcggctgcttttaatccggagctgcacgccttggaggaaaggcaaaaagatcgagccgatgtcgagataatcgtcgtagtcaatcacgtcctcgtcgttcacatcccacgggccgcggtccacaccccgctcctggcctgtcaggcgtgcatcctgctcagggtcctcaacgtcggccttgcctgccgcttcgccgtgatcctcgtcttgagccgccttccgcttcctgccgaaaccgaacaatcccatgctttcctcgtttctttcctgccacaaccgttaccagcctagcaaagaagcgggccgaccccgaacagggccagcccgcttcctccgctaactacctagtcgtccagaccaaggctcaacttgccgcctggaatggcatccagcaggtccttggtgtattgctgctgggggtggtcgaagacctcgtctgtcgtagcgtgctcaaccaaccgtccgtgctgcatgacaaccacctcatccgcaatctggcggaccacggccaagtcgtgagtgatgaacagatagctcaacccacgctcggcttgcaggtcgttcagaagccgtaggacctggtcctggaccagcacgtcaagggccgacacggcttcgtcgcagataatcacatccgggttcagcgccatggccctggcgatcgcgatgcgctgacgctggccgccggacagctcattggggtaacgccccatgactgaggatggcatctccaccatctccagaagctccttgattcgcttctcccggctcttcttatcgccgatgccgtggatgcgcaagggctcctcgatggagcggtagatggaatacatggggtccagggaaccgtacgggttctgaaagaccggttgtacatgcctgcggaagtccagcatctggtgggagttgaaggatgcggtatcgctgccttcgtagatcaccttaccggaggagggtttgagcaggtggaggaccatgttcgccacggtcgacttgcctgagccggactcgcccacaatggccagcgtggtgccacgcttgaccgagaaggacacatcgtccactgccttgaacatctccatgcggcggggcagcctgaactcacgggtcaggtgctccactgtgatgatatgctcgctcttctccagggtctgctcacccttggcgtggtgctccatgaaactctcagcatcctggccgcgctccttagcggagatgatccgctgggaggccaaggagggagccgcatcgaccaaacgcttggtgtatgggtgctgggggtgctgcagcacttccaggctgggtccggactcgaccacccgccccttgtacatcaccacgatgtgctgggcgcgctcggcggccaagcccaaatcgtgggtgatgaagagcactgcggtgcccagggagtccgtcagaccctgcaagtggtccagaatcttcttctgaacagtcacatccaaggcggatgtgggctcgtccgcgatcagaaggtcaggccgcgaggccaggcccatcgcgatcagggccctttggcgcataccgcctgagaactcatgcgggtactggcgggcgcgtgtggcggcatcaggcagaccggcctcggacaggaggcctgcaatacggtcggcggtatcggaacccttgacgtactgcttggcgatcgaccaggcttcctcgtcgctgacgccagcgccgatcaaatccttagccacgccccagcgggtctcggagccgggatcccactccgacttgaagtaatccatagccttatcgacgtcggacttgcccgcgttgatgacggcctcccgagccgccttgagcagttccggcaggtccttcgaggcgatgaagagctcatcgtcctggtttttcagggtcacgtcctcggaggacgcgagcatcttggccagttgtgaacgcttctctcgggtcacgtccatatggttggcgaccagagcctccttgacctgggtcccaatcctccagaccgggttcaggttgctcataggatcctgaggcaccaggccgatttgctggccgcgcacctgctcatagtcctttttgctcagcccgaccagctccttgccatggagcttcatcgagccgccgatcaccttgccggtgcccggcagcaggcccaggaccgccatagcggaggtggacttgcctgagccggactcccccacaatcgccacccattgaccggggtagacgttgaaggaggcatcggtgaccgcatgcaccgagcgtccgtcggcgttgaagtcgacctggaggtccttgacatcgagaagggggccaccctccacctgcgcctgggccaatttggctttgatgctgtctgcttgactgtgttcactcatgctgttctccaactcacgccgtacggctcttcggatccagggcgtccttgaccgcgtcgcccatcatgatgaaggcgaggacggtgatggccagggcggccgatggatagaagagcacggaaggattggtcctcagaaggttctgcgccgtcgagatgtcgccaccccaggagaccaccgacgaaggcagaccgatgcccaagaaggacagggtggcctcggagacgatgtaggagcccagggacatggtcgccatcacgatgaccggagccagcgagttagggatgatgtgccggaaaaggttgcgtataggcgaggagcccaaggccgtcgaagccgtgttgaactccaggttcttggcttcaaggaccgcgcttctggtgatgcgggccatgttcacccagccgaagagggtgagggtgaagacgatcttccagatggaggtcgaggtgcggaacatctgcaggaggacgatggcgcccaggagcataggaatcgcgaagaagatgtcggtcacacggctcaggaccgcgtccacccagccgccgcagaagccggcgatggcacctaccaagccgcccatgatggttaccagaatcgtggtcgccacaccgatcgagaccgaggtgcgggcgccgtaaatcacgcgggagtacacatcgcagccctggaggtcatatccgaacggatgaccggagccaccgccctccaatgagttctgcaggttgcaggagaccgggctctgcttggtgaaaagcgccgggaagagcgctaccagtagcacgaaaattaccaagacagcggagatgatgaatatggggtttcgcctcagggtcttccaagcgtccgcccacatgctggtggccggaaccgcctcgttgatcgagtcaacatccttgaggggggtctggtccaggggcgctacgaaacgctcctgtcctggcaaggggtctggaaagaagacctcagcgtttgagtcgcggcttgcgctgttcattgtcatgtctgtcatcaatccttcacccttcacgcgtaccggatgcgcggatcaagcaccgcatagagcatgtcgaccacgaggctgcacaatacgaagatcatcaccatgatcgtcacgatcgagaccaccaaggtgccctcgccgcgcaagatggcctgatagagcgtattgcccacgccttggatgttgaagatgcgctcggtgatcatcgcgccgcccatcagaccgccgatgtcggcccccaggtaggtgaccacagggatcagcgagttgcgcaggacgtggcgaacggtgacttggaagtcgctcatgcccttggctcgggcggtgcgcacgtagtcctctgagatgtttgttgaaatctcagtgcgggtcagtcggattatcgatgccatcgagaccgatccaagcactatggcgggcatcaacaggtcgatgaagccaggcgacgcgccggccgtagccggcaggaggtgccacttcacgccgaagaggtactgcaggatgaagccggtgacgaaggtaggcactgaaatcagcaggagggagatgatcaggatgatctgatcggaccacttgcctttggtgaggccggagacgatgccgaagagaatgccgaagatcccctcgaagacaaaggccatcagcgccagcttgattgttaccgggaaggctcgcccgatcacgcttatgactggctggcctgcgaaggtcttgccgaagttcagggtcagcgcattcttcaggaagagcaggtactggacgaagaatggcttgtccaggttgtattccgatcgtatctgggcggctacggcctgattgaccggcttgtctccgaacatcgcggcgacagggtcaccaggcaacgcgaaaaccagcgcgtaaatcaacagagtcgtaccgagaacaacgggaatcatctgcagaattcgacgcagaagatatttgcccatcggcttttctcctttgcaattcgcgggcagggtgtgcatgtaagctccgcccgcatgaaaatactttttgcagtgtagcagcagcacttaaccggaaacattacgaaatggcggaaacgccgaccggaaagctcgcttgtctcaggctgtcggggctggtccaggtcatgcgcgctggccagcccctgcctgtcatttcgttaaatcagggtagaccggggtccccttccaagtgaaagcgaagccgtgaatccctttggcggccacccctttggagttggcgtaatagaggggaatcgtcgggaggtccttgagtaggatctcctcggcttgctggaaaaccttgttggccgcgtctgtgcttttggctgcggcggcctggttcaaaagatcatcgacttgccggtttttatagtccccatgattggagccatgaccgccggccgagctcgaagcgaacttgggcttcaaataatcctccggggacgggtagtccggctgccaacccgtgcggaacgccatgccgttggcggcgaaggtgcgtcgggtgatgttgccgttgaactcggagaaagtcgggatgggcgaaccggccgcgtcgatgcccaaggagttcttgatcgaattggcgatcgcgtcgtatatatccttgtgaccgccgtctgagttataggccatcttgaaggaatcgttgggcgcccagggcgatatggcattcgccttcgtccagagctccttggccttcttcggattgtacttcaagacgtcaccgcccttgagcgaagcggagtatccagggatgggcggagcgatgaagtccgtcgcgggcttggcggtgcctgccagaaccttgtcaatgatcttctgacggtcaatagacatggagatggcctgccgacgaaggcgaccttcctcgtcctccttgaagtgattcatggccgaagggatggtgatgtattggaaaaccgaacccggctcagactttgcctgcacgctctggtcagacatgtaggttttcaaagcggatgtagggatggtgtccatcacgtccaggttgccggactgtacgtcggcataggccgcggttggatcggtgtagttccggaattccagaccaccgttcttgactttgatgtctccctggtaatccgggtttttgaccaggacaatcgacttgttgtgctcccaggacttgaatttgtaaggtcctaccgagacgggcttctcgccgaaggccttcgtgtctttgtaaaagacctcgggcagaggggcatacgaggtgtagcccaccaggatcgggaaggtcgaagaaggagcgttcagctccacagtgaacgtgtgatcgtcaagtactttaaggcctgagagttgtgcggaaggatccacaccactggcttgcaagtcgtcgaaacccttgattgggttgaagaaactggagctcaactgcccattggccgcgttggcgccccaggaccaagccttagtgaaggaggaagcggtgactggagtgccgtcggtgaacttccacccatccttaatggtgatcgtgtacttggtcatgtcggcgttgggcttgatttccttggcgatgtcgttgacaggtttgcctttgtcatcgaagcgcacgagcttggagaaaagcatgtccagcgggttgccgccgcccacctcattcgtgttcgaaggaatcaggggcttggcgggctcggaaccaaagacgctgattatcgcgtccgtagtgctgccggcctgtgggttgttgtcattattagcgttattcgaactaccgcacccgctcaaaatcaatgccaaagagcagacggaggtcgtcaaggcggtcaggctggtcttcctcatcattgaatcattctttctcaatcagggatttgggtgggatggttctctggatgggaggtggcattcgccgccctcccatccagaggcggggactacttggtcagattcgtgtagtcgggagtggccttccaggtgaaggtgaagccgtgcacgttcttagcggcaacacctttggagttagcgttgtagagcggcacgaccggcaggtcctccaggaggatctcctcggactgctggaagcacttgttggcttcatccgcggtcttggcctgcgaacccttcttgagcaggtcgtcgaacttcgggttcttgtaatcgccgtcgttcgaaccattgccatcggccgcggccgtggagtagatcggctgcagatagttctccaacgaggggtaatcaggctgccagccggaacggaaggccgaatcggtgaacttacgggccgacacgttgttgcggaactcgttgaacgtgggctgggggttgccctcggccttgatgcccagcgaattcttgatcgaattggcgagcgcgtcgtaaatctccttgtgaccaccatcggaattgtaggccatcttgaacgtatccgaatcggaccaagccgagatcttgttggcctcagcccacaactccttagccttcgtcgggttgtacttcaacacatcctcgcccttcaaggtcttggaggaacccggaatcgtaggggccgagaagtcggtggccacagtgccggtgtcgcccaacaccttgtcgagcagctgcttgcggtcaatcgacatcgagatcgcctgacggcgcagcttgccttccttgtcctgaccgaagtgcttcatgtaggtaggaatcgtgaaatcctggaagacgggaccaggttcgtttacggcctggacttgggaatcggtctggaaggtcttgatgtccgcggagggaatcgtgtcgagcacgtcaaggttgccggactgcacatccgcataggcagcggtcggatctgtgtatgagcggaactcgatgccgccgttcttcaccttcgtgtcgcccttgtaatccttgttcttcacaagtttgaccgacttgttgtgctcccaggactggaacttgtacggcccgtcagagaccggcttctcgccgaaggccttggggtccttgaagaaggactcaggcagcggagcgaagtaggacatgccgagctgggtcgggaaggtggaagagggaacggatagctcaaccgtgaagctatggtcgttctgaaccttgaggccctccagctgcgcgtccgctggcacgcccttggcctgcaaggcgtcgaatcccttgataacgccgtagaaactggaacccagctgggcgttgttcacgttcgcgccccacgaccaggccttagtgaaggaggaagcggtgaccggagtgccatcagtgaacttccaacctggcttcagggtaatcgtgtactgtgtcatatccgcgttgggcttgatctcctgagcgacctcgttgtgagtcttgcccttggagtcgaagcgaaccagtcctgagaaaagcaggtccatcgggttcccgccgcccacctcggtggtatccgaggggatcagcggtttggccggctcggatccgaaaacgctgatcatcgcgtccgtcgacccttccggcgattcagacgccttgccggaatccgacgaaccgccacaagcgctcaaggcgattgcgattgagcaggctgacgccagcaaaaccgccgtgcgtgatttccttatcatgattaccttccttactgcatgtgaacttcacatgaacatgcgcggcgtggttgtaatatgcgcccccgacgcctgaaccgcgccgcgcaagaattcagtctgggagggaggaggtttacccctcccccctcccactccatccagggttacttagtcatgctcggataatcggggatgccctgccaattgaaggtgaagccgtgcacgttcttagcggcaacacctttggagttagcgttgtagagcggcacgaccggcaggtcctccaggaggatctcctcggactgctggaagagcttattagcggagtccacgctcctagccgaagccgctttcttcaagagctcgtcgaacttcgggttcttgtaatcaccgtcgttcgaaccattgccatcggccgcgccagtcgagtagttcggcttcaagtagtcttcgggcgaggggtaatcaggctgccagccggaacggaaggccgaatcggtgaacttacgctgggtaacgttgttgcggaactcactgaacgtgggctgggggttgccctcggccttgatgcccagcgaattcttgatcgaattggcgagcgcgtcgtaaatctccttgtgaccaccatccgaattgtaggccatcttgaacgtatccgaatcggaccaagccgagatcttgttggcctcagcccacaactccttagccttcgtcgggttgtacttcaacacatcctcgcccttcaaggtcttggaggaacccggaatcgtaggagcgatgaagtccgtggccacagtgccggtgtcgcccaacaccttgtcgagcagctgcttgcggtcaatcgacatcgaaatcgcctgacggcgcagcttgccttccttgccctcgccgaagtgcttcatgtaagaggggatcgtgaactgttgaatgacggcaccaggggtgttcactgcctggaccatgttgtcggtctggaaggtcttgacatccgcggagggaatcgtgtcgagcacgtcaaggttgccggactgcacatccgcataagcagctgacgggtcagagtagacacggaactcgatgcccgcgttcttcaccttgatgccacccttgtagtaagggtttttgaccagcctaatggacttgttgtgctcccaggactggaacttgtacggcccgttggaaacaggcttctcgccgaaggccttggggtccttgtagaagctatcaggcagaggggcgaacgggccgttgcctatcttgacggggaaggtggaggaaggggcgttcaaatcgaccgtaaaggtgtggtcatcgacaaccttgaggccggagagctgggcatcagcggcaacacccttttgctgaagttcatcgaaccccttgatttcgctatagctatcggaggctacctgggcattggcggcattagccgcccaagaccaagccctggtgaaggaagtcgcggtgatcgaggtgccgtccgagaacttccaaccatcctgaatcgtgatcctgtattgggtcatatcagcgtttggcttgatttccttggccacttcgttgaccatcttgcccttggtgtcgaagcggaccagggtcgagaacatctgcccgattggatggccgccgcccacctcattagtgtcggagggaatcagcggttttgccggctcggaaccaaagacgctgattatcgctttgctgtccgacgcctggttcgcatccgttgatttatcgctggattcattcgaacccccgcaaccgctgagcacgagagccagcgagcatgcggaagcagctacaagtgaaaacgctgaggctttcttcatcttgatcttcttcctttgtcaggtacatcttcttttgctgctggcgaaagcggaggttaccgccttcttatacgcggcgcttggaccgctccccgcggaccaagcgccaccacccgactactacggaattattttgttagttcctcgtagacaggtaagttcttccaattcatcgtgaacccgttcacgttcttggccgctgcgcccttggcgttggcgtagtaaatcgggacggccggcaaatcctccatcaggagcccttcggcccgctgataaatcttgttggcttcgtccacgctcttggcctgagccgcctgggtgagcatgtcatcgaacttggggtttttgtaatcgccgtcgttggacccgttgccgtccgccgccgaagaggcgtagaggggcttcaggtagttctcgggcgaaggatagtcaggctgccaggaggagcgcaggacggcatcgtggtactttcgggcggatacgttgttgcggaactccgagaaggtgggaacaggggtgccttcggccttgatgcctaaagtgttcttgatggaattggcgattgcgtcgtaggtgtccttggcgccgccgtccgagttgtaagccagcttgaaggtctggtcagcgggccatttggagatggcgtccgcctgggcccaaagcttcttggcttccttgggattgtatttcaggacttcggagcccttcaaatccttggagtagccggggattgaaggcgcggtgaaatcggtgggctgggtacccatgccccccaagaccttatcgatgatctgcttacgatcaatcgacatcgagatggcctgccgacgcagacggccctcttggtcctccttgaagtggtccatgaaggaggggatcgtgaagccttgagtcaccgaaccgggctcgttgtaggcctgaactgtggaatcggattggaaggtcttctgagccgaagtgggaatcgagtcaatgacgtccaagttgccggcctgcacatccgcatagccagcgtccacatccgtgtagatgcggaattccaggccgccgttcttgacctgggccgtgcccttgtagcccttgttcttgaccagtttgatggccttgttgtgttcccaggactggaagttgtaaggaccgaccgtcacaggcttctcgccgaaggctttggtgtccttgtaaaagacttcgggcagcggggcgaacgcggtgtaacccacctgaatcgggaaggtggatgagggggacttcagatcgaccgtgaaagtatggtcgtcgaggaccttgaggccggagagctgggcattcgccggggtgcccttggcctgcgcctcgtcatagccctggatgttgtcgaagaaagaggcatccagctgtgcgttgttgacgttggcgccccaggaccaggccttggtgaaggaggaagcggtgaccggcgtgccgtcggagaacttccagccgtcgttgatcgtgaccttgtactgggtcatgtccgcgttggccttgatttccttggcgatctcattgtgagccttgccggacttatcgaagcgcacgagcttggagaacatcatatcgagcgggttcccaccacaagcctcccccgtatcggagggaatcaacggcttcgcgggctcacaaccgtaagcagaaatgatggcatcaacactagagaccctagacttgtcgtcctggcctgacgtgccgccgcaacctgcaagcgctaatgatagcgcgcaagctgacgctgcaactatggtgagcttcgggctcttcttcataactgtgcttcttctccttcagtccaacaccctgcggctttgtgcgcccaggatggaaacttggcctcaccccacgaattaggcttgcacctagcccatgaagctaattcaactattctcttacgtaaatgtttcgttcgcaagacatgttctcagtgctctcgcaagggttgggcgagaggatctggtccataaaccaaggaaccacaggccgccagcggacaagctgcgcccgtgaggttttcaaggctttacaccctctttgccaggagcatttataggactctcacagctcactttccgctatctgggttaaggagcggcaggattcagcaatgttacgaaaacgtttctgccgtgttctggatttcagctcacagccgtcatactcaagactttggagccgcttccgtcactacaggcagctccacaggcaagctgaccggccactggagccccagggcccaggtgaccggtcagacttgaggagagagtctacttgctggtgacgctagccatccagtagaccgggtagttctgccagctcatggtgaagtccttcacctgcttggaggcagcgccagtgcggttcaggtagtagagcggaataccgggcatatccctcaaaaggatgccttgagccttggcgtagagggcgttctcctctttgctgtcagcggccttagcggactgcttgatcaagtcatcgaattcggggttcttgtagtcggtatcgtttgctcccttgccatcagccgagtcagaggcatagatcgggtgcaggtagttctccaccgatgggtagtctggggtccagccagcgtggaaagcaccagtcatcttacgagcggtcacgttctgacggtactcctggaaggttgccacgggcacatcttctgtgtcgatgcccaggttggacttcaccatgttcgccacggccttgtagaccgacttgtagctggtctcgtcggcattgtagctaaaggtgagcttgtagtcggcaggaatcttggaaatcttgtttgcctggtcccacagctccttggccttcttcgggttgtacttgatgttgccggagttttccagatccgtcgtgtatccgggaatcgtgggcgccgaataggaggccgctggggaagcggtgccgttgagcaccttcttgcagatggactcgcggtcgatggacatggagatggcctggcgacgcaggatgccttcctgatcttccttgaagtgctccaagttagagggcagggccacggcggcgatactggaaccagccttgttgaaggactgcacgttcgtatcagaggtgaaggtcttgctggctgaggcgggcacgttctccattaagtccagattcccagcctgaatatcggcgtaagcggcgtcggtggacgtatatattttgaaggtgatgccgccgttgcgaggcttgaactgacccttgtaataagggttctttaccaactgaatggacttgttgtgctcccaggattggaacttgtaaggaccattacccaccgggtgctcgccaaagcccttcgggtccttgtagaaggactcaggtagcgggaagaaggcatcatagcccaccttgattgggaatacggaatcaggctgggtcaaatcaacggtgaacgtcaggtcatcaataaccttcagaccgctcaactgggcgtcagatttaatgttggtgtcctgcagctcatcgtatcccttaatcagggagaggaagctggaacccttctgcgcattgaccgcattagccgtgtagctccaggccttggtgaaggaggaagccttgactggagagccgtcgctgaacttccaacccggcttgagcttaacggtgtactgggtcttatcagcgctcggggttatcgagtcagccacctcattgaccgacttgccgtctggagtgacgcccaccaggccagagaaaagcatggagctgggcctgccgccaccacgctcgttggtatcccctggaatcagcccgttctgaggctcagtatcaaacgcggtgataatcgcgttggaatcggatttcgccgaggagtccgaaccttcggacgcacttccgcaggcgcccagggatagggccacgatacaggctgcggcggtaatcgttatcttctgtttagtgttgtgcacgaaaccatcctcttcttctcaggtgtgtgactgccgaatatggctggtctcccccaaccaccaacgaaaatgcagaaagaactctcctgttgtttcgttaggggtcacagtagacaatcatcgttacgaaagagggcaaagtgtccaccagttggacagtttcttttcaagagtcgtcatcccatgctcattcgcgggcggctttcgtgcggcgaatgaccgttcccacctatacgcgacaggcattgaacggggagacttaagcccgcgaaaacactcagtcgtaacgcccacgcatgcccactaattgaaggatgcgcatcacgctggcccctatcgtaagtgctgtcatccaggcggatgaggcgattccctatgccctgagcagccatatcgttcacagtccgcgacggctcacatcgccctgggcccagggcgcttcctccaagggatcctggtcactggccgcacagctcgggcgttcgttgccggtcgtaaggtgagtcccgacgcattgctccgccaggcccaccccgctcgcttcggcacgcgcctgagacggacataacccgcgttgcccatggcaatggtggtgccccgcagcaaccagccattttggcgcttttacctcacgaatgctccagacgcgagaacagccggggcgcgcggagcaaagccgaactccagcatttccctccgctcctcactgaataggctacggccctggttctttcaagacggaacacaccacagcgcccggcaccaagcaggtgcttggggccgggcggaaaggggttatggcacgagcgtactacctttatgctctttgctgggtccgctcatttggaggacgggacgctcatctgccagtaaacagggaagttctgccagttgatcgagaagcccttgacctgctttgccgctgcgccgttggcgttggcgtagtagaccgggatgccgggcaggtcgtggagaagaaccccctgtgcctggtcgtagaaggactcgacctcagactgggaagttgccttggccgcctggttcatcaggctgtcgaactggctgctcttgtaatcgctgtcgttggcgcccttgccgtccgctgcggcggaaccgtagatcgggttcaggtagttctccaccgacgggtagtcaggcgaccatccggcgtggtaagcgccctgaatcttacgctcggtcacgttctgccggaactcctggaaggtggggatgggcacatcctcgcagttgatgccaaggttggtcctaaccatgttcgccaaggccttgtacaccggcccgaagccctgatcggcgttgtaagtgaagtccaacttagcgctcgtgggccagggggagatcttgtcggcttgttgccacaagctcttggccttcgccgcgttgtacttgatgttctcggagttcttcagcgaggtggagtatccggggatcgtgggggccgagtagctcttagccggcgtggcggtgccgttaagcaccttcttgcagatcgcgtcacggtcaatcgacatggagacggcctgccggcgcaggatgccttcctcatcgtgcttgaagtgatccaggttgcccgagattccaacggattcgatgactgatccgggcttgttgtaggcctgaaccgaggaatcggtggtgaaggtcttactggctgaagatggcacgttctccatcacatccaggttcccggcttgaatgtccgaataagcggagtcgttggctgtgtacatcatgaagttcacgcccccgttacgcggcctgaactggcccttatagtcggggttcttcacgagctgaatcgacttgttgtgctcccaggacttgaacttgtattggccgttgcccactggatgctcaccgaagcccttcggatccttgtagaaggactcaggcaagggcgagaaggcgttgtatcccaccttgatcgggaaaatcgagtcaggctcggacaggtcgacgatgaaggtcaaatcgtcctggaccttcagacccgacagctgttcatcggacttgacgccagacttctgcagatcgtcataccccttgatcgtggagaaatagctcgcgttcttctgtgcgttggccacgttggccccatagctccaggccttggtgaaggactgcgcggtcactggactgccatcggagaacttccaacccggcttgagcttgaccgtgaactgggtgttgccggaattcggtttgatcgaatcggccacttcgttgacggccttaccgtccgggctgaaggccaccaaccgggcgagaatcagggacaggggcttgctgcctcctcgctcgttggtgtcagcgggaatcagcggcccctgaggctccgtgtcgtaagcggtaatgacagccgaggcatcaccctggtcatcagctcctgaagacgccgaagagccgccacaagcagccaaggacagggttgcgatgcaagccgtcgctgcggcggcgagtttgcggatggtatgggtcacgaggacttcccttcattcttgtaatcactagacctagtacgcatgattcctgccgatccggggccgctcatgcgcgaagcggccccgggacctgcacctgtctacttggtgacttgccagtagacaggtatgttctgccagcttatccggaaggacttgacctgcttggaggccacagcattagcgttgcgattatgcaaggggatgctgggcaagtcccgcaggagcaggccttgagcctgggcgtacaaagcattggcatccttggcggaactcgcttctgccgccttgtcgagcaggtcgtcgaactccgggttcttatagtcgccatcgttcgagcccttgccttcggcggaaaccgaagcgaagttgggagtcaggtagtcctccggcgaggggtacgagggagcccaaccagtgcggaaggccccctgtatcttgcggcccaccgcgttctgccgcagctcttggaaggttggtatcggcgtgtcctgcgcatcaatgccgaggttggtcttgaccatgttcgccacggccttgtagatggggccatgatcgccatccgcgttataggtgaaggagaacttatggtccgccggccagggcgaaatggcatccgccttggcccaaagctccttggccttcttggggttgaactggacgttcccctcgttcttcaggtccttggtgaagccgggaatcctgggcgaggtaaagtcggctgcaggcgtggccgtgccgttgatcactttcttgcaaatggattcacggtcgattgccattgagatggcctgccgacgcagacggccctcctcctggtccgtcctgaagtgctccaagccagcggggattgtgaacttttcgatgaccgcgcccggtttgttgtaggactgtaccgaggaatcggtggtgaaggtcttactggcggaggtgggaacgttctccaccaggtccagattgccggcctgcacatcggcgtaggccgaatcccctgaggtgtagacgacgaactcgactcccccgttgcgcggcttgaactgacccttgtagtcggggttcttcaccacctgaatcgacttgttgtgctcccaggacttgaacttgtactggccgttacccaccggatgctcgccgaaccccttcggatccttgtagaaggactcaggcaaaggcgcgtaagccaggtaacccaccttgatcgcgaacgtggagtcaggctggttcaggtccacagtgaaagtgcggtcatctgtgaccttaaggccttccaattgctcatcgcccttgtggcctgcgccctgcagctccttgtaacccttgatggtggcgaaggaactggaatccttcatagcgttagccgagttcgctacatagctccaagccctggtgaaagaccgcgaagtcacaggcgtgccgtcggtgaaggtccagccgggcttgattttgatggtgtatgcggtgttgtcggcgttaggcttaatcgattcggccacctcattgacggccttcccgtcagggtcgaaggccaccagctgggagaacatgaggttgccaggcttgctgccgcccacctcattggtatcgcctgggatcagtgggctctgcggctctgccgagaacacgcgaatcatcgcgttaggatcgccagcctgaggagaggagctggaattggacgatcctccgcaagcgctaaaggacatggctacggcacaagccgaggccacaagggccattttctttccgcgaggggacatgattgcgactcccgttcggtatgggggacgatgtcgaaaggtttccgtgcgtgcagagggtactgcgacgcttaacaaccgaagacgacgggggtatagccgcttggtgcatgaaagtgtatgacatgcatgttacggggactgaatccatccactattcggacgaacgaccttgtcaagcgccaatccttactggcggcgcttaagcgcgcgggaaggccaaatcgtagcgttggcggagctgtccgatggaaacatgcgtgtaacgctgggtggtgcgcagagaggaatggcccagcatctcctgaacctcgcgcaggtccgcaccgccatccagcaagtgggtggccgctgaatgccgcaaggagtgcggggagatggacggtaacccggcttggacggaaatacgatgaaccagttcccgcacctggcgctggcctattcgaccgccacgggccccaaggaagagggggcggatcgccaacggatcgtccgccttccgaccgctcgcggcctccaagctgggcctgccctgatccagccaggcgcgcagggccttagcggcgggcagaccgaaaggcacaactcgttccttggagcctttgcccatgaccgtgaccgtgcgggcctcccagttcacatcgcccaggtccaggccggtcagctcggctactctcataccagtggcatagaggagttcgacgatggccttatccctgacagccagcgcttgcctgcgacggtctgcctgggatgcgctggctgactggtcagcccggtctatcccgctgcccgcctcatccatcatgcgggcggcctggtcctcgctcaggacctgtggcaggcgctcgggaatcttcggggtggcgagtgccgaagccgggtcgctccgcatgacgccgcggtccgctaggaaagcgaaaaagcggcgaatcgccacggatttgcgggccatggtcgagcgcgagtgggtccgatcctcatgagccatccaggaacgtagcgtctcgacgctgacctggtccaggctggtcaaaccgcgccgttcaatcagcgcaaggaactcctggacatcggcgcgataggccttgatcgtgttggggctttcaccctcaacctggcgcaggtaggccgtgaaagcggttaggtgctcgtcgaagcgcatagtgggcctcctgttgcgcatcccattgtaatcagcccgatagaataacgacggaaggagcgatatgagactaccagatcagatacccaccggggccaggctcgtggtccgcgtcgccgaagcccccgaccagccgaacgggcgcatggccttcagggactacataggtcacgtacgttcctggaatgggcgaaccctcgccgtgacgagggatgcgaccgcgaacggcagacggccagagcaagaggtctcgatcgacgcgagcaccatcgttgcccttaagcccatacccgagcgccggaagggcgcgatggccccaggaagcgccgaagaccctgcctaagcttgcgcaagtccgagcgggcaccgggacagcacagcctggtgaacgctggtgaaagccgttacctgccaacctcgccgggccgaatcctggagctgcccctgccagccacgctcgtccaactccagaatggaggtctctgcggcagggggctcggcctgagcctggccagggaccgtcagcggttgcgaatcaacggctgtaagccgatcgtgggtgctgtcgtccatgcagatcaacggattgcccaggccttgggtgatcatgtcggccacggtcaggaaacggttgtaatccgtgccccgatcgacgcatagggcccagaccgcgtcgttgaaggggtcaaggggccgcaccgcgttctcccttattatagggtgagcgccgacatactggtcctgcaaaccgacagccatgactcgcttgcgcgcctgagtctgattacggttcaggtcgatcaagacactggcttgagccaggacgggggccacatttgtgaggatcgagggcagaagcgtcgactcgacagccagggcgaggacatctggtttacccgaggccagttcctccaaagatctcatcatgcgaataccgtcgcttggcgcggactgtccggactggacgtccgggtcccaggctacgacgaaacggccccggccggtcaggcgctgagccaaagccaagccaataggccccaggcccacgacaccgaccttatgggccgaggtaaggatgggcgagggtgccatgcctggaagcggatgcatgtcgtaaactcccccgcctgaagccgccgcgcgatgggccggacaagccacagagcgggcgcctgacggcccctcttccccttgcagcgcaccttgtcggctcaggccgctgtacgcattgaaagcattcacgcttaccgcctgccagaaacgggcgtaaccatgaaccaacgcctgggcgcgacgaggaccgccagttggaggaccagggagccgatcagccaaatcctacccgcatgacggtcgaagaaaccaatgaaagcggggctgccgattggcaccaggacgtcgccgcccggaccgcgacccatcagcaaccaaatcaggcaggaggcgcccaccaagtgcaagcccaatccggtcgcgccagcccaggacctcgcccaccaggaggaagccgccaaaatcaggaaggcaatcaccaggccgtagggcagcgaccccacggccccgctgcggtgggccaaggtgccgaccagaccggatacggcgcccaaagccagggctgccagataggtaagcgccatgggcgtggtcttctcttgtgaatgactcatgtccgccagcctatccctagaggccaaccaggccaagggtccgtcaggagcgggcggttaccagtggacgcctggacagcgaaaaccgccccaggtcggacggggcttggagccccgccgtttggcgcggttctaggcgaacctgccggacggacccgccggaagcgcttacttctgcttctggttggccctgcgctggcgggcgttccacttgtaccaggcgtcacggtccaggatgattttgcgaacgcgaatcgcttcgggcgtcacttctacgcactcgtcgtcgttggcgaaatccaaagattcctccaagctcatctgaatgggaggggtcagagtctccaacacgtcggcggtggaggagcgcatattggtcatatgcttctccagggtgacgttgatgtccaaatcgccgggcttgttggtcacgccgacaatctgcccctcgtagaccggggactggggcgagacgaagaagttgccacgtgcctggagcttctgcatggcgtaggggctggccttgccagcacgatccgccaccatcgagccgttttgacgagtggagatctcaccggcccagggggcgtacccggctgaaatggatgaagagatgccggtgccacgggtggcggagagcaaagcggtgcggaagcctatcagaccgcgggaaggaaccgtgaactgcatacgcacccagcccgagccgtgattggacatggagtccatccgacccttgcggtccgccatcagctgggtgaccgcacccatgtactcctcgggcacgtcaatcgtgtcggactccataggttcgttgagcttgccgtcaatcatctgcgtgaccacctgcgggcggcccacggtcagctcgaagccctcgcggcgcatctgctctgccaggatggccagggccagctcgccgcgaccctgcacctcccaagcatccggtcgatcggtgggcaggaccttaatcgagacgttgccgataagctcgcggtccaagcggtccttgagcatacgtgcggtcagcttgtggtccttgccctcagttccgaccagcggcgaatcgttggtgccaaaagtcattgaaatggcggggtcgtccacatgaatgaggggcagaggcttggggtcgtcggggtcgacgatggtctcgccgatcatgatgtcgtccacgcctgccacagccacgatgtcgccgggtccagcttcctcgtcaggcacgcgatccaggccctgggtgcgtaggatctcagtgagcttaaagcgctccaccgagccatccacacgggacaggccgtactgggctcccttcttgagggtgccgttatagattcggaccaggcccaggcgacccaggtagtccgaggcgtcgatgttggtcacgtgcgcctgcaggggggcgccttcctcgtacacgggagctggaatgttcttcaggatggcatcgaacaagggctccaggtcatcgttgtcaggcagaccaccgtcggcgggctggttgaccgaggccttgccggccttagccgcgcagtagatgaccggcaggtccagcaaggagtccaaatccaggtccacgccctcctcggagacatcctgggccaggcccagcagaaggtcggtggactcggagaccacttcggagatgcgggcgtcgggacggtccaccttattgacgcacaggatgaccggcagcttggcctccagggccttgcgcaagacgaagcgggtctggggcagcggcccttcggaggcatcgaccagcaggacgacgccgtcaaccatcgagatgccgcgctcgacctcgccgccgaaatcggcgtgtccaggggtgtcaacgacgttgatcgtaatgccattaggctcgttcaactcagccgccaacgggcctgtgtacttgacggccgtgttcttggccaggatggtgatgcctttctcacgctccaaatcgttggagtccatgacacggtcgggcacctcctcgcgctcggagaagacgtgcgactgctgcagcatggcattcaccagagtcgtcttaccgtgatcgacgtgagccacgattgctacgttacgaatatctccacgaaccgccatcaaaacctcattctcaaacgctgctcaactcttggcagacaaaccctcgcaatgatacgcgcatcaggtgacagaaaagtacagcatcgcttcaaacctgccgctgcccatgatcaggaacgaccccagggccgctcccctggtccggccgaaccccacgcaaggccgccatctcctggaccgccgtgccctcatccggcaggaaaggagccagggaaggcagctcgtcgaccgaatccacgcccataagctctaagaaaagccccgtggtcaccagcagggcggcacggctctcaggatccaacccttcctcccttaccaggccacgcaccagcaaggaacggatgaccccgtccgaattgacccctcggatgcccgccacctgagctcgggtgatgggctgcctgtaggcgatgatcgccaaagcctccagcgcggcctgactcaggtgagcgctttgcccctgggtggcgaaggcagcgactaccggttggtagacaggcaaagtagcgaagcgccagccacgggcggaacgccgcaactggaagccatgcccctcccgctccaagcggtggctcaacccctccaggcaggattcaacctctgccgccccggcttgcagggcgcaagccagatcctgagcctgctggggctggtcgacggccattaaaacagcctcaaggcaggcgtcaaggccaccagggaaatcggctgggttcagaggctttgccctgtgatcctccgggtcctcctggggccgcgcccgctcctgctcactcatgcgaaatcctcctcgctcatccgctccagccactcgctcgttggaccgccgacccagcgtagggagagaggctcgaatggccctgcttgcttgtattgcaggtcctgctggcggaaaagcaccagtacggccagaaaacggcccacgacttccagccgactgtgggcgtccgcaatcaacgtggcgaacgccaccggccttccatccgcctggaccagccggtcgcgcaccagtcgggcctgctctcgcaagtccaccaggggcacgtggagctgggccacagcgacctcgctgaccggcgcgttggccaaggcgcgcgccgccagacgcgccagctgctccccagtcgtcgtccaaaccaaggctggcagggccgccgcgatatcagcgtccacctgacctgggtggggatatgcggcgacgttttcctgcatctgatcgccaaagcgctcggcggcctctttgaaggccttgtattgcaagaggcgtgcgaagaggagatcgcgttcgcgaagggcttccatcgactgctcgtcagttgcctgaccgctgcggtcaggcagtagagccgctgacttggcctccaccagaatcgatgccacatccaggaaggagcttgcctcatccatgctctgggctaggtccagccgccgcacatagctcagaaactcctcggtgatgactcccagggagacctcagtcagctccagccgccggttggccaacatgccgagcagagcgtcaaaaggaccctggtagacatcgagctcaaccgagaatcctggggccgcctcacgctggtcgttcacgccacgatgccgcgcgcgaccagttcccgggccacctcccggtactccttggccgtcttgtgctggggggcgtacatggtgattggcgcgcctgagacggtggcgtccggcagcttgatcgacctggtgatcaccgaatggaacaccttgtctttgaaagcctcataaattcgttgaaggacctcatccgagtgcagagtgcgggtgtacatggtgaccaggaccccgtagacctgaaggtcaggattgatgcgggtgcgcaccttctcaatcgactgcatgagcaaggcgaccccgcgcaaagcaaagaactccgcggccacaggaatgatgaccccgtcggcagcggtgagggcgttgacggtcagcaagcctagcgaaggctggcagtccacgatgatcacgtcgtactcgtcgatcagtggcttcagggtcgaagccaggacctgctcgcgccccacctcggtgaccaactgcacctcggcggccgacaggtcgatgttggcgggaatgatgtccaggttgtcgaagcggctgtgcatgaccacttcgtgcacgtccaggctcggatcgaacagagccgtgtatatagtgttctccacgctattggcgttgatgccgaggcccacagtcgcggccccttgtgggtcgaagtccacaatcagcacccggcgcccgtaagtgctcaaggctccgcctatgttgatcgaactagtcgtcttgccgaccccgcccttttgattgcacatggctatgacccgtgccgggccatgctggctgagcggccggggggctgcgaacgtctcgtattcgcgtcctaataaatccgtaggcatacctttacactaccaacatccgttaaggagtggcttccggcgcttccaagccagtcagaaccgactcccaccaagccccaagcccctcatcctccgctatatacgctttcagtatattcgcccccctacctcaacgcgccctcggatgggcggtctggtaggcctcgataaggcgctgggggctcacatgggtgtatatctgggtcgtcgtgaccgaagcgtgtcccagcagctcctggaccgtgcgcacatccgcgcccccctcaatcaggtgggtggcgaacgagtgacgcagggtatgaggatggacgggtcggtcgatgccggctcggtcggcggcctgccggaccacctgccagaccgactggcgtgacagtcggcggccccgtttgttgaggaagacggcgctcatctccggtgccttgctcgccttgcgacccaagccgggccggcccacggacaggtaggcctccagggcccggcgggcgtaggacccgaccggcaccagccgttgcttggaccccttgcccgtcagccggaccaagctttgcgccaggtccaagtcccccaggtcggcccccacggcctcactgacccggcaaccagtggcgtacatgaactccagcagggcccggtcgcgtaacgacaccggatcctcgtccccggggaccgcagcggcggccaggaggcgggagacttcgtcgattgagagcacatcgggcagacgcgaggcccccccgggagccttgacgccctgggagacatccacgtccacaagcccctggcccagggcgaagcggtggaactcgtggacggcggctagcctgcgggctttgctggcagaggattcaccgtcgagcgaagccaggaaatcctgcacatcactgcgctccacccgccgcacatcacccttgccacgcccgcgcaaccacgccgtgtaaagggctaaatcgccgcggtaggcctggacggtggccggagccaggccgcgttcgacgccggtatggaccatgaactgctcggtcaatccgctaagctctgtggggttcccgttcatggagctcactgtaatcccctgctcatccagccaaacactggcctagaatacgcggaaaccccgcgcaaggcggggctccaatcgtccggcccttaaggcctgactctgcgctgagccgtggctcaggcggcgacgggcgcgttcacatcggcgggcagagccttcttagcctcttccactatcgcgttgaaggtgtcgatgtcggagaccgccagctcggccagggcgcgacggtccaggtcaatgccagccaggcgcaggccctggatgaagcggttgtaagtaatgccctgagcgcggcaaccagcgttgatgcgctgaatccacagcttgcggaagtcacccttgcgggccttgcggtcgcggtagttgtagttgtaggaatggaggagctgttccttggccttgcggtagaggcgggagcgctgtccacgatagcccgaagccctatccagtacgaccctacgcttcttatgcgcgtttactgccctcttgacacgtgccatgttctttcctcagctttctaagatctcttgagacttaccgatgatgctcattcagctcggcggcttacttgttcagcatcttcctcatgttcttggcctggctcttggcaagcacggcatcgcgcgagagggcgcggcgcttgcgggccgacttgtgctcaagattgtggcgcatgctgctcccagcctgcatgagcttgcccgtgccagtgacgcggacccgctttgatgcggcggaattacttttcatcttcggcattgctgccctccttggatgttatcttcttcgtggaagtctgcttgtcgtccggctcggagtcgattcgggccacctcggcctgcgcctctccttcagcctggaccttagccccctggccctcctgctttgcggccaagcgggcggcctgccgggcttgacgctcggctcgggcctgattgccgcgacggcgctgctcggactgggtgtggactttcttgcccttgggcgagagggtcatgatgatattgcgaccctcctgcttgggcgaagactcgatcgaacccaaatcagcgacctcatcggccaagcgcttgagcagttcgacgccaccaatcggccggcgctgctcacggccacgcagcataatcgtgaccttgaccttgtcgcctgcggacaggaagcgggccacatggccctttttgacctggaaatcatgctcgtcgatcttcaggcggaagcgaatctccttgatttcggccgccgtctggttgcgacgggcctggcgggccttgaccttctcggtgtacttgtactttccgtagtcaatgagcttggccaccgggggtttggcctgaggcgccacctcgaccaaatcgaggctggcttccttggccaggttgagggcgaccgaggtcgcgataatccccacctgctcgccgttcggaccgatcagacgcacctgggatgcccgtatgtcgtcgttaatccgtggttcttcgctaatgatgactccttctaccgctgcttctcacattgccgcgaagctcccgaagatggaccgggtcatgcgtccatgcagctggacgcggcgccttcgggcagtgccctggtcaccggacgaggtccgatctcatcaacccggagccgtaaaaggcccccaggtgggaagttccgctttcttgattgctcaagcctggaatcactatagcacaagaagacggacagggtttcccgacgcttcccccctccccacgcccaaggcgcgacgaaggaggctggcccaacatcattgaacccgcaaaggaccacgaacgtcgtagcgcgctaccgaacccatgcagctgcggaatccgcacacctgaaaggtgcttgggaatgagttgcaaggacagcgcctccgtagtacgttcccaggcgactccaacgaccatatcggacgaggccatcttccacaacaaggattgggccgcgtccccgacagccacccgccgccgggacacatcgagaatctcaccggtgccaaccaccaccgcatgcacccggaacttctcctgcgaccgctgccgcagctccagggccgaatcaccctcgcgattgactgtgaactctataattccctggtccttggcctgggccaatatgcgggacacggtgaatggcgtcgctctgctttgagctggacgccatccgcgcatcgctggcttgcgtctgagtatagtgcgtcagccagggcgcgacgcacgctcgaggaagacgacggggccacgagggccaccagctcacccggcgcggtccacgacctccaaataggcgccatacccttgagcctccatgtcctcgcggggaatgaagcgcagggccgacgaattcatgcagtaacgcaagccaccgagctcccggggcccgtctgtgaacacatggcccaggtgggagtcggaagcctgggcgcgcacttcaatcctcggtctgcccagcagcttgaaatccttgcgttcggtcaacgaccgccgattgatgggcttggagaatgagggccagccgcagcccgcgtcgaacttgtcagccgaggagaacaacggttctccgctcacccggtccacgtaaatgcccggacggaagtcagcgtcgtaagcgttctcgaaaggccgctcagtggccgcctgctgggtcactcggtactgcagggggtccagcgcccagatctgttcgatgaaccgctgccgcctggccaccccggcgatccgatcggcggatatgtggcagtagccatccggatgcttgcgcaagtagtcctggtgggactcctcagccaagtagaagttgcgcaactcctccacctccaccacaggctcgcgcccctccctatcagccagctgcttgagcgcccgtcggaacactggctcctgctcggcccggcggtccggctcccaatacatgccggaccggtactgccgcccgcggtcattgccttgccgatcgcgcgaaaacgggtcgatcacatccacgaacagcagggtcagcgtacgcaaggtcagcatctgggggtcgtaaaccacctccacgcattcgaccgcgtccgtgccgcccgcgcacacctgctcgtagctcggcgactccactcgcgattgcgcgtatcccacccgggtggaacggactccggacacgccctgcagatagcgctcaagcccccagaaacagccacccgccaggtaggccgactccaattggcgtgccttaacttcgctcatcgttcatcccctcgcttctgcgccagctcctccagcccagtacccgcacaacagctcccacccctcccgtattccgtcacggctcccactatccttccatcccacaccctctcgtatagccgcccgtgcccccctcccctcacaggcccccgccacccctccctgccggtttccgcccccactcgctaggctgggaaccatagggcgccagccgtgggacggtggcatagggcgagcggagagcgaggcgggaatgtctcaggcaaacggcagggatgtctgcctggtgttcggcgcaggcgactactacgacagcctggccgaaccggggtgcctagaaagccacggcctggtaatcgcggcggacggcggcgccgaccgggcccgggccgcgggactggagcccgacctgatcgtgggagatttcgactcaatctcctctcctccccagggagcggatggcggtgtcattcgtctgccggccgaaaaagacgacaccgacatgcaggcggccctcaaactcggctgggcgcgcagcttccgtcgcttcaccatcctgggcgggctgggcggcagaatcgaccattcgatcgcgaacgtggcctgcctatgcttgctggcccagagcggtggccacggggtgctggtaggcgatggactggccctcaccgtcattcgcgacggccggctggacttccccgcctggtggcccagcccggaggacggccgcatggtctcggtcttctccgcctccgacatctcgcgcgaagtcagcgaaacaggactcaaatacggcttggagcgggcggaactggaccagggcatgagctgcggttccggggtcagcaacgagttcctggacggccatccggctcggatcgaagtgggccagggcagtctgatcgtcagctacccgctgtccgcgcccaggcccagctggcacaccagtctggaacccgctggcaatctgggcccactggacacctcgccctcggcccggctcaaccgcatcagaccagtggagccgcccggcgacgcatgaaccccgcatgccgggcggctccggcaacgtagataagcgattaaccacagccaccacatacaaggaagcgttcaccatggccgaccacgcgcaaaccctattcatctgctatccgcgctgctcaacctgcgccaaggcccgcgcctggttggatgggcacggggtggattacgtcgagcgcgatatcaagacagacaaccccacgtacgaggagctcaaacgctggtggcaactcagcgggctgcccgtcaagcgtttcttcaacacctcgggcatgtcctaccggcggttggaagcggaccagcgacccgacgccctgggcgacgacgaggccctccatctgctggccaccgacggcatgctggtcaagcgcccgattctggtggacgacgggcaggttcttgtgggcttccgcatgagcgattgggagggtcatcttaacgcccagccgcacaagaattgagcgaatgaacatggaaagccacaacaaattaccacattttgaatgttcgtttagaaggactcacaagaaagatattcgcaaggtggaagtacatgctgagcgttagaatatgagtcgttagcaacaaatgaccgccgctggccgattcacattaggccggcgactggtcagagtctgagggagtatacatgacagtcaagattggtattaacggcttcggtcgtatcggtcgcctggcattccgtcgcatcttcgagcttcaggcccgtggcggcgaggccggcaacatcgaggtcgcggccatcaacgacctcaccaccccagccatcctggcttacctgctcaagtacgacagcacccagggccgcttccgtcacgacgacggcagcccggttgaggtctccgccaccgacgacgccattgtcgtggatggcaaggagtacaaggtctacgccgagaaggacgccaacaacatcccctgggtcaagaacgacggtgtggagtacgtgctggaatgcaccggcttctacacctccgccgagaagtctcaggcccacctgaacgctggcgccaagaaggttctgatttccgctccggccaaggacgccaccacccccaccgtggtctacggcgtgaacgaagacatcctgaagcccgacgacaacatcgtgtccgccggatcctgcaccaccaactccatggcctcgatggtcaaggtgctggacgacgaattcggcatcaagatcggatacatgaccaccatccacgcctacaccggcacccagatgctcctggacggccccaagggctccaagccgcgcaacacccgcgccgccgcgatcaacacgatcgagcactccaccggtgccgccaaggccatcggcaaggtcatcccctccgtggacggcaagctccagggtcacgcccagcgcgtggccgtgcctgacggctccgtcaccgagctgaccacaatcctgaacaagaaggtcacggtcgaggagatcaacgacgccttcaagaaggccttccccgccgactgcgagtactacgagtacaacgacgatgcgatcgtctcctccgatgtcatcggtgacacccacgcgggcgtcatcgacggcacccagaccgacgtgaacaacgccggtgacgagcagctggtccgcaccgtctccctgtacgacaacgagtacggtttcacctgcaacatgatccgcaccctgctctacttcgccaagatcgccaagtaagcatgagcgctgactgatacagtcaagcccaagggcccggccacgcgaattaccagcgtggccgggcccttgcctttaccgccttttaccatcgcatatccaaaacccctgcaaccccatcgcccggagcctcagcgagcgcgggagaccaacttcatgaccgcgtcgcaggccgctccgacgaccatgccagccaggaatcccaggcccatgaccgccaagggattatcggacagccagcccgcggccaggtagcctagcgtccacatgtaaatcgaccagaggaacccagccaaggccgccagaggcaagtagcgggccagggggtagcgggcggccccggcgatcaggttgatgaccgtgcgccccgagggcacgaaccgggaggccacggtgaagaatcctccaccgtattcgaaggcccggtgggcccaggagacgaccgatttgcccagggagctacggaagaaaacgattctgcgcaggggcaccgaccggcccagccaataagtgcaaacgtctccccccgcgaaggccagggcgcaaaccgcgaagacggaccagggcgcgggagccccggtggaccgataggccgaagcgagggcaagcaccatcagctcggtggggatggggatgatcagagcatcgaaaaaggccgcgaacgcgagcgcccacaacccccagcccaaagagaccgtggccaggagccaagcattgaaggcctccatgcccccacttccctcccgatgtaggcgactgagccttactatacaggcatgggcaagagatcgaaacgacaggggacggatgcctccaccccggcggtggcacagttggaggcggcaggcgtggccttcactccctacgaatacgagcattcggccgaccatatggatggcggctatggcgccgaagcggcggctaagctggggatggacccaggccaggtctacaagaccctgatggccgacacaggctccgagcgtgtgatcggcatcgtaccggtgtcaggacggttgaacctcaaggccctggccgcagcggtaggcgccaagaaggcccgcctagccaaccaacgcacggccgaacgcgaatccggctatgtcgttggcggcatttcccccttcggacagcgcagcgagcaccgtacggtgctggatcagggcgccctggccttcgaccgcatcctagtctcaggtggcaaacgcggcttcgacgtggcggtctcgccgggcgatctgatcgccttgttgggggccagcaccgctcccctggcctgtgactgaccgctatccaagccgtaagcgccttgtgctgacacagtggaagatggcgctgcccctaaggctaccaaagattggactgggcggcgcctcatgcccatgggttgccgaacgagcccgctctgccgagacgtaatggttgccgtcgaccgcgacgttcctgcgtaaagacggaacgacacccccaagcctggggtaagcgtcaggcggaacctaccaggcaccgtgcgcttgaagaccgaccgaccggcgggcgaacggggaaccgtccacacgcgcgaaacaagcctggcggaaggaggggaggcgacggtagaatgtgagcggtaacgcattctcctattgggaaggtcaatgatgagcgaggacgccaagcaggcagtgatgccaaggaccgggcaacagtattcgatttcgcacggggattaccaggcgatcgtcacccagcagggagccacactgcgggtcctgcgataccgtggcaaggacctgatcgcctccttcaggcaggatcaggcgattccgtgctccaacgggtgcgtcctggtccccttccccaacaggatcgaggacggcgaataccgcttcgatggcaagacctaccacatgccgattgacgagcatgagcgtggcacagccatccacggctacggttaccggtactactggcagctggatgagctcagcgagtccagcgtcagcctgtcctggcgcacaccctccctgccctactacccgttcgacctcctagtcaccgtctcctacgtcctggacgaggatgggctgaccatgattgtaagcgccaaaaaccaaggcggagaacgcgccccttgggccttcggaatccacccttggctgtccaatggtcaagaccaccgcggcgacgcgatccaggccgacaacgaggcatgctccttgctggtgccctgccgcacccatgtgcgcgtcaacgacaggctgattcccaccggcgaggagaccgtccagggcgactacgacctcaccgacggccccagcctcaagggccgctccttcgacgacgcctggtgcgacccacaacgtgacaggcaggggcgttcggcggcggttctgacccgtccggacggcatccgtctgaccctctggggggataagaccatcaacgcctggcaggtctgcaccggcaccggcttcgatgcctccttccgcccggccggcgtggccgttgaaccgatgaccgcctatgcgaacgctttccggaccggtaaggatctggtggccctggagccgggccagacctacaccacccaggtcggataccgggctgagcaggcctgattccaaccgcaggctcccgtccgcatccccctaacggctggcggcggtcgggagcctgtgcgatactatgtcgaggcttattcgatcagcagcaaaggagtccatcatgggcatgcgcggacgcaagcgcagggatcgccgcaagaaggccgccaaccacggcaagcggccaaacacctgatttcgctcgccacttgagcgaatggcaggacgcccgcggattcaaatcacagcacttgaatccgcgggcgtcgtcgtatcggttcgggggggggggggcctcggaagccggaagccgccgctagccgtgagtcttagccgaccaagggagaaggaatcggccgaacgattgcctgaaatccgctaaccgcccaggaaaagcggcttcacgctgcccaacgaacgacgcccgccatcagaccgaacgctgcgccgtgcggtccaattcaccatcctcttcaggggcttccaccaaggtgtcgaacatgcgctggaggcgctcaatcaaacaggccggtgcgctttggggacgcagataggcgcgcaactcctcgatgagccgccgctcctgctcatcgcagcaagcgcgcggatcgaaacagtcaccaggaagggcgctctcgccggaccccacagcggagatacgcaggctggcgtgggtcacgctgacctgcctgtccttggaggagtaatggctcatctcgatgcgcgcaaccatcgctaccccttccgcctgtgtgtttcctgataaattatcgtaaacccgtttaagccccgttcgcaccgttccgctcaaggcgtgtcggccctatgccccttcggaccctgtcctgggtccgtgtcagccgttgcgattgagctggtcgagcccgctaaagccttgcgaccgccgccgtcgccattcgcgccggattccaggccgtacccgcgttccgccgcgtatttttgcagctcctgcttgagctgggtgcgcgcgcggttcagccggctcatcacagtgccgatcttaatgccctgctcatcggccacctgttggtatgattttccgtcgatcgccgcgtcgatgaagacccgccggcgctccggactcagcgtattcaaggctgccatgatctcctcgggcgcgaaagtctccaaatattcttgctcagccgactttaagccttcagagctatgctcagaagctgagtaaatatcccagtcgttgtattcgccggttgagccattcgcgcgttgggggcgccgtttggctttatggtactgattgaagaaagcgttacgctcgatcgtggtcatccaagcctcgaagttactgccgggctcaaaccggtcaaaggccttgaagccacgctcgaaggtgtcctgcaccaggtcttgtgcgtcctcggggttattggtcagcttcatggcctgccggtacagcacgtcgaccgcaggcatagcgagctgttcgaagcgcctcttgcgcccctccagctcagacagttccgccacacttccattgtgccatctctgtggacaccgcggaccatcggcgggttttgccagatgagagaaggagaataggcagtatgtccgacacgcttaccgcttttgagcagcacttgaccgcagccagccagcaggacgatcagaccagtctggccgagtcctggctcctgggcctggacaccgaaaccaccggagtcacaccgggcaaagatgccatcgtatcggcttgcctgatcctgcgcaacccggctctgggcttcgagggcgacatggtggccgaatggataatcaacccccaccgcagcatcagttccggagccagcaaggtcaacggcttcacgaacgagtacctgtccgagcatggggacgagccgatgcaagcaatcggacaaataggccgtctgatagcccaagcccaggccaagcgcatcccgcttctggcctacaacgcccccttcgacatccaaatgcttaacggcgatataacccgctggtgcgaaggcgagttgcaaccgttcgaaaccgactccatgctggtcgtggaccccctggtcattgaccgggccgtctccaagcgccgggggcgccggtccctctcatacacttgcgagtactacggggtggttccccggggcaacttccataacgccgcagccgacaccatcgccgccgtcgacttggtcaagcccatgacgacgctctacccgcaagtcgcccatctgaccctgggagagctgatggactggcagcgcaaggcccatgcggactggtgcgaatcctaccaacgttgggcccaagcacggggcaacaggcggcggatgatgaacgccagctggctctaaccaccccgcgacggaccaggctggtgtcggcccacgagcgcaggaagacacggacgcgccaggtgaagcaaagacgccgacgaggcctaggcccggcggtagactgtgagcgaatccagcactcaggaggcactagcagagcatggcacttagcttgaattcagcactcgcaatcctcaaggaccacgggcttctgcgggagctgatcgggcccgaggggtggaccctgtcggcgcaggggccgtcggcggatcaggatttcacctcgatcacctacgactcccggcaagtgggcccaggcgccctcctgtgctgcaagggccacttccaggctcggttcatggatggtctggaccaggccggattggccgcctacctggctgaggaggacttctcccaacggacgcaggccccgggccttatcgtctcgaatgttcgccaggccatgagcctgctggcggccgagttttacggccgcccccaggagctcctcaaattggtgggcatcaccggcaccaaaggcaagaccacgaccgcgtactacgtgcaggccttgctgtctcaggcctcaggcggccgggcggccctgctatcctccgtggacaactgcttggacgggcgcacctacaccgagtccgagctgaccacgcccgagtccctcgacctcttccgcatgatgaggcaggcggccgacgcgggtatgcgctacatggtcatggaggtctcctcgcaggcttataaggtggaccgagtccacggattgaccttcgacgtgggtgccttcctcaacatctcgtccgaccacatcagccccgtcgagcaccctaccttcgaggactacctgtactgcaagcggcagatcgcctataacagccgtctcctggtcttgggggccgaccacgcttatgagggactggtgaaggaggacgcggcgaaggccggcattccaatcaccacgttcgccctggacgcggggaccggtccatccgggaccgatcctgggcaggccgctacttgggtggctcaggtcgaccggcggaatcccggcgtcaacgccttccaagccctccggcagggccacccagccggttccttcacactggccatggacggcctgttcaacggggccaacgcggccgcagccctggcgatcgtcgatgccctaggcgtgccgatgagcgaatccgacctccagaccttgagccaggtgcgcatctccggacgcatggagcgcttgagcgcgccggggattgtggcttatgtggattacgcccacaattacgcctccaccagcgccgtcctggacttcgtccacgataagtacggcgggcagcccctgtcgatcaccctggtcaccggatcagccggcggcaaggccgtggaccggcgcaaggagatcgtcgatgccgcccaatacagggtcgaccggctgattttgaccgaggaggacaccgagctggcgtccgaacctgcggaaagcatctgccaacagatgatggataacgtaaccaatcctcagttggacgcctcaatcatccaggaccgaggcgaggccatagctgaggccgtgagaggagcccagagccacccggagcgtctggatgcgatcctggtcatcggcaagggcgaggagcgatggatcaagcgccagggcaagcatgtgccctacgaaggcgacgaccacgtcctggcccgcctgctcaaatccggcgacccccaaacccagcaagagaaagcgagcgagtgagcgccatgagcgacttccaaccagtgatcctaggctccgacatcaacgcctacggcatggcccgggccttccacgaggcctacggcatgacctccacagccttcgcccatttccagctgagccccaccaagtacagccgaatcattgacgtgcacttggttccaggcttcgaccgtccggcggcattcgttcagaccctgagagaatacgctcagcggatgcagcgcgaacggcccggcgttcgcttgctccttatcccctgcggcgacacctacgccaacctactggccggcgcccgcgagcagctggagccttactacgccttcaacaccctgaggccggaactcaaccgacagctctcactcaaatcctccttctaccagctgtgcgagaagcacgggctggcacaccctgccacgatcagcctggacgcggagggcgtggaacgcggcgattaccgcaacctgcctttcaactaccccgttgccatgaagccggctgattctgacgcctggctctcggtgaactttccaggccgcaagaaagccttcatcatcgacgatccacaggagctggagaccacgattcgccgctcctacgaagccggatacactggcgaaatgatcatccaggacttcatccccggcgacgactcccgcatgagggtcctgaacgcctacgtggaccagcaccatcgcgtgcggatgatgtgcctgggccatcccctgctggaggacccgaccccggaggcggtgggcaattacgcggccatcatccccgattaccaggaaaaagtgttcgggcccatcaaggccttcctggagtcgatcggctaccagggcgtggccaacttcgacatgaaatacgacgagcgcgacggacgttacaagctcttcgagatcaacctgcgccagggccgctcctcttacttcgtgaccctcaatggagccaacctggctacctactttgtgcaagacctggtggaggacgccccgttcgacgggcgcaccttgtacgcgcggggctccaagctatggatggagatccccaagtccatcttcaccaactacattgagccgggcgaggataagagccgaggcatcgacatgatcaagcgcggcgactggggcaccaccctggagtaccggcgggacatgtcgcccttgcgctggctgatgatccggcacatgttcagcatttacaagaagcgctataagcagtatttcaggcggaagggggatttgcgatgaggaatttcttcgccatcctaggcggcatggggacgctggcgactgagagcttcacccggaccctggacagggctaccggcgccggccgcgaccaggatttcctgaactatctggtcttcaacgacgcctcggtacctgatcggactgcctacatcaacgaccacaaccagccggacccctaccccgccctggccgaggatgtgcggcaggccagcgacatgggcgcctctttcatcgtgatcgcttgcaacacggcccactacttccacgagcggctccaagcgggcacgagcgtgccgatcatccatatgccccgcacaacgatagagtgggcgagcgagcactaccctgcggccaatcacccccgtttggggttcatgggcaccgaaggcacccgtgattcgggtctctaccgccgactggccaaggacgcaggctaccagctggtggagcctggggacggtctgcaagagcgtgtgaacgcgctgatttacgaggacgtcaaaggcggcaggctcgatcggggccactatgagggcgtaatccacgaactactggatggctgcggctgcgacgcagtcctcctgggctgcaccgagctctcggcgctgaacgaggccttccccttgccagagctgccgattgtcgacgcgcaagcggtcaccgtggacctggtggtgcgtcgggctaaggcggagcagggcaagtagaccgccagcgcctggctgtcaacgctgcggccttggccctcaagcctcggctctgacccgatccgtcaatgcgcttggcaatcggtccacagcccggcccaggctctagaggcgctcagcgcggtgttcgcgtttcagtcgccggcgagggcctcctggccctgggccagtttctgggagatgaccgccgtcacaccatcggcccgcatggtcaccccgtacagggcgtcagcgattgacatggtgcgctgttggtgggtgatgatgatcagctgggcgtgctcgcgcaactggttgaaggccttgagcaggcgggagaggttcacgtcgtccagggccgcctccacctcgtccatcacatagaaggggctgggtcgggccgtgaagatggcgaagaggagggccaaggccgtcagcgaacgctcgccgccggacaggagggagagctgcttgaccttcttgccggccggactggcttctaccagcacgccggtggtcagcaggtcgtccgggttttccatacgcagtctccccttgccccccgggaagagtgtggcgaacatctgctcgaatgcagcggccgtatcgtcaaaggctgacttgaagacgtcgatcatcgtccgatccagatccttgatcaaatcctttaaatcgtcccgggagctaaccacgtcctggcgctggtcgttcaggtactggttgcgcgccttcaaggactcgtactcctcggcagccagggggttgaccttccccagggcggccaaatcacgcttggccttattcagccgcttgatctgctcctcgcgcacatagggcacggtctcgcaagccccgacatgcacatgcccggcgagagcgtctgcccctttctggtcgttgcccgcattctcccggtgttcctccagcgagccagacatcgggaccggtgccccggtctcatccaataccggtacaggacgctcgggcccatagtcccgaatcagctcatcgacacccatacccaagtcgtcgctgattttttgaatcaactgaccggactgggtggccagacgctcccggctcacatcaaggtcatgctccttggcccgcaggacctccacctgcggctctaggccatcgcgctgggtccgcaggtccttgagctcgctgtcatgggaggaaacctgggattgcaggcgatcgcgttcctccaccgtttgctcaaggctggctgccaacagtcctacgaccgcgcgcgcgtcgtggcccacttcgcccaggaggctgatccgctccgcccgctcctggttgagccgagccacccgttcccgccgctgctgcgcctcctgggcctgggtgcgcagaagttgcgactgccgcgctagtgattcacccttgcccttagcgtcgttccaagccatttgcgctttcatctcggcggcacgggcctggtccagggcctcctccagccgccgggcccgctcggtcaactcgtccacattgacctgctccgatccggaacgttcggcttgttgaagcgtcccttgcagatcctccaacttggcctggtggcttttgacctccaaccccagtacctcgatgcgatgctccgccgtctggagccgcgcctcctgctgcctggtcagcgtcctggcggacgccagggccttggcgccctgctcagccttgagccgatcttcggtcctcttggctttggcctcctccagtctgtcttcagcctgggtcaagctctgctgagccctgtccacggccttctgggcggcatccaactgcccgctcaatccctgcgcccctgccaaggccttgtccctccgggcgaccaaggccaaatcactcgtggctggaccagatccgccaatggcaccgacagcggtgaacacgtccccctcacgggtcagcacttcgtcccaggcccccttcgctgtggagcctgcggatgccagcagttccatggcatcacggccagtctccaccgcggctgtacgggacagcaggaggcggacagccgccagcacaccctgggcctgattcgagtcaagcacatcggatcgggcgctgaccaaactggcggcgctgcgaattcgatccctccgcgcggtgctggcgggagcgcgggcctgcccgaggtcctgcccctgctcgtgccccacgtccaggggagtcagcagcacggccttacccagcttgtcctggtgggccttctccaaagcatgttggactccctgcccgtcgcggaccacaatcgcgcctgaatagtcggctagggcgtgagccacaggctcctcccacccctcctccacctggatgaagtccgccagtcggccaagcattcgcacgccgccttcagcggagagccgctccgaggccgagcgcgattccaaggtgtcgctcagcgcgtcggccttggcttcgagcgctattctctgcgagttgatcttgcgctgggtctcctgggcgtcattcaagccctgcctggcggcggcgcgggccctttcggcctcctcctgggccgccaggccgtcttcgccctgtcccgccccggcctgggcttcaagttccagggactcctcctgctcgtgggcctgggtcaactgagcagctgcggcgtcacgttggacttgggcgtcggacaggcgcccttcaaccagttgcagagcggactcctccttggcgaccagggccttgaggctggtcaactgggcatcgtgctggcgggccgtgcgttgcagttcggtcagggtctgccgggccgcggccaactgctgctcctggctggccctcacctccaccgcctggtccaaggtcagccggctctcttccaagcgggaggcctgccgccggccctgggcgtcgagttcctcggccctgcgggccaggagctccgggtcgggcccctgtccagcgccctccatctgcccctgcaaggaacgcgctcgttcaccagccagggagatcaaggagctgtagcgctcctggagctgggtcaggtcgtgccaaacctggttaatccggctgatccgcgggttggacttctgactcagagcttccacctgctcgattctcagtttcacctgagccagatgccgctggcgctcggccagctcctccctgaccctgccaagctcctcccggacgtcgtcgagggactgcctggctttgacagcgtcctccgcgtaaatccgcgcttgggcatcgcgcaggctgacttcgatgccgtcggccctccgcgagacccgggcctgccgccccagtggacccagctgcctgtggatttcagacagcaggtcatccaggcgggcgaggttgtcgtcggtgttagccagcttacgcaaggcccgttccttgcgcttgcggtgcttcaagatgccggcggcttcctcgatgaaggcccggtgcccgctggggtcggcgcgcaggatggcatccagccgcccctggccgacgattacatgcatctgctggcccaagcctgtgtccgacagaagctcctggatgtcgagcaggcggcaggccgagccgttgatcgcatactccgagcccccgttgcggaagatggtgcgggagatcgtcacttcggtgtagtcgatgcccaaagtgcggtcggagttgtcgatggtcaggctcacctgagcccggcccaggggcggccgcgaggaggtaccggcgaaaatcacgtcctccatcgaggagccgcgtagggccttggccccctgctcacccatcacccaagccagggcatccactatgttcgatttgcccgaaccgttggggcccaccacggcggtgatgcccggctcgaagcgcagggttgtgggtgcggcaaaggatttgaaccctcgcaggctgagctctttgaggtacatcaggccctctccgccttgggtttgcgcaggtcggggctcatgtgctccttcaacagggcgcgcgcgtcgccagctgtgacgaaggacccgcaaatcaggactccgtgcccatagccgacgcccagctcgtcttgctcgtccaccagattcacggctgtttggatggcgtcgggcagggcatcgcgacgcaagacccggtctgggccgaagacccgcttggcgatgacctccagctcttcggccggcatgacccgctcccgccaggagttctcggtcaccacgatctggctgagcaagggctccaggacgcccaagtattcctccacctgcttgtcgcgcatcatggcgacgacgccgacgacctgctcgaagctgtagttctcctcgatcgccgcgcgcagggattgggccgcattgaggttgtggcccccgtcaatgatgattgtgggcgaggagcgcgcctgctctatccgtccgggcactttgacctggcttaaggcctcagccaccaggtcggagttcaaagctccgttgaccggggcgacgacctcggccgcagccaaggcggacaaggcgttgtgggcctggtggtcgccgaacttgtcgattggcaggtcctcataagtgccgttgggggtgcgcagggtggcgacttgcccgccgacggccggctgcctggccacgacctccaactcgcgcccgtcgcgcaggatctcggacgcttggcgttcgcgcgccgccgcctctatgatcggcatgacctcgtcctcgtggggctgcgggccgacgatgaccgtggaaccaggcttgatgatgccggccttctccgtggcgatctgctcgaccgtgtcgcccagccactgcatgtggtccatgtcgaccggaccgatgatagcggcatccgcgtccagggcgttcgtcgcgtcccacatgccccccatgccgacttcgactacggccacatccaccggcgcatcggcgaaagcccaaacggccatggcggtcagcacctcgaagaagctcatggccggaccgccctcctgggcgctcttggcgtcgacgatcgccaccaaatccttgatttgctcgtaaacgtcgacgaagtcgtcatcgctcaactcgcgcccatcaatcgcgatccgctcgttgatccgctcaaggtggggcgaagtgtacaggccggtgcgcaggccgtaagctctggcgatggcctcggtcatgcgtgcggtggaccccttgccgttggtcccggtgatatggaccacgcggaaggaacgctcggggttccccatcaggtcgaggatggctcgcattcggtccaggttcagattggtcgtgttgtgctcggccgggcgagccatgatctcccgctccacctcgcggatgctgcgaccctggctgttgggatgctcataagacataaccggaactctcgcctccgactggcgcgtaagaacccgcgcctctcgtactttttatgactgaatcccattctaagtggctcccaggtccgcgcccgcccggctcggccccaggctaagaccggcgagttcgcctggtgcaactaggatgggccctatcagctggcaggtgacgcgaattgggcgcggtccaatccccaagcgcatatcaaggaggcatggcatggcaggcagcacaacgccggacgagtcggacgtggacatcaacgagcaggacatggcggaccgggtgaacaaccgcaccctgcgccctaattcagcgactttccaagagttcatgacccagggttggggcgagcaagaggccgccgtcaagccgctggagtcctcccagtacatcggcgcgcgcctgaccaagctcggtaagcgcttccccggcgaacgcctggtcatcccggccggcgactataagacccgcaacaacgacaacgactaccccttccgccccgactcagctttcgcttattacacaggattgggagaggacttggagccgggcgccatcctggtcctggacccgctgcctgccgactccgcgcaagcccaggcgggagcgacccaccaggcggaattgttcgtgcaccctcgggccgaccagtccacccgcgattactaccgttcctcccagtacggcgagtactgggtgggcccgcgcgccgggctccaggaactctcggtcatgacaggcctgcccacccgggacatcgccgagttcgaaagcgcgatcgcctctggcgtgggccccgatgacgggtccgtccgcctgcgggtcctgcgccacaccgaccagggcgtcaccgcccaggtggaggcggtgcgcaaggccaaggggcagtgcagcccggatgagggggtggcttccgacaacaagttcgaggagttcgcctccgaggcccgcatgatcaaggatgcctatgaggtgggcgagatgcgcaaggccatcgcggccaccaaggacggcttcgacaaaatcctgagccgcctgcccgaagtggtcggcaagccccgctcggagcgcatgttggaaggcgctttcaacgccaacgcccgcgaggagggcaacgacgtaggctacggttcgatcatcgcctcgggctcccacgctccggtcttgcactggatgcgcaataacggcaccgttcgccagggcgacctgctcctgattgacgccggcgtggaggtcaactccctctatacggcggacatcacccgcaccttcccggtgggcggtcacttcagccccatccagcgccgcatctacgaaaccgtgctggaagcccagcagaccgccttcgaggcggcccagcctggcgccacatactcggatatccaccatacggtcatgcgcgtgctggccacccgcctgcacgagtggggcatcctcaaggtttccgtggaggagtcgctctccccccaaggccagcagcaccgccgttggcacgcctgcggttgcgcccaccacctgggactggacgtgcacgactgcgccgaggcccgctacgagtcctaccagggggcggccatcgaacccggcatgatcttcacgattgagccagggttgtacttcaaggacaacgacctgctggtgccgcctgagttccgaggcatcggcgtgcgcatcgaggatgatgtcctcatgacggaggacgggccggtctggctctccaagcagattcccaagaccgtggacgaggtggaggcgtggatggcccagcaggccaagcaagaccggtaaatcgcaacaaaccagctaccccgcaggttcacgggcaggtcaaattcaggtccgcccggatcctgcggctcgacgggaattccgggcgggtccgggtatggaaagaagactctgatgcctactcccgatttcgtcctggccctgcgctccaaaatcggccacgacctgctctggctcaacggcgtcaccgcctacgtgcgccggcccgacgggcgcatcctgctgggccggcgctcggacaccggcgagtgggccctggtctacggcatcaacgagcccggcgaggagcccgccgacaccgtggtgcgcgaggtcaaggaggagacaggcgtggatgtggtcgtcaccgccctggtctcggtcaagtcctccagcgaggtcctgacctacgccaacggcgaccgtgccatgtacatggaccactgcttcctgtgcgaacccgcacctgctggcaactgcgagccgttcgtaggagatgaggagagcctggaggtcggctggttcgaccccaagcatcttccttctcccctggccaaaactaccgtggagcgaatggccctggtccaacactacctagaaaacgccgccggcggcgaccccagcgccctcttcgccggcggccggtgaatcctggccaatcacttcacacagaaaatccaaaaggtcgaacatatgcagctgcgcccgcttgataaaaaaagccgcgggttcccccgcagaccaggattataatgttgaggattttgcgcgcctgattcagggcttacctgagcatttgctgattcccgacgcttttgaacaagccgattgccaaactcatagacgttggtggacttctcaaaagcaacacatgactgctctggatcgaatgtcttcttctaagcagtgccacaaccatcactcagaaaatcataaacaaaggaagcgcgagaatctccgaaaaagtacgggaatcgactactgccacagacttctccgtctgtatccctggtatggcgacggagctcacaggtttcccatgagatgcgctttgccaaaccgcctcgaagcatgggacaaatcttggcagaatattcccatctcatgtctcacctctatagccagtgcactcagtcgtggtcagtttccaactgcaaagcacgcgggcaagatcccgattcacacaaccaacagttttagtggttgccatcaccagaaccctcatgttggcgtgaataatcgacagccttccctcatcagggccactatcctgattgaaagccgcatcaaaatgatcatgaatagcaatcgaccaatgcggtctgtttcgtgctccaggttatgaaaagaaagcgggtggctccgctagagcgattttgccacacttgagtgggattcgtctcccacttgtcattgcagcagacgatgcttcatcttctagcgcattttgagtccttcaatcatcaactaactctatggccgcacggcctcataaaacatgggcgttccatccgaatccccattctcaagagatatatccccataatcaaggcactaacgtctaccagtaaattacccgactgaatacttgtactgatatagcgggaatctctacataaaatcaggcgtatcaccccttctaagaccaaggcaggattacgaagcgagatgccatgacttgctaaaaccgaaccctctctacactcttaaccaaagaacaccgcggcagcaaattctcacttcgcctggggcagtaggtgaagggtgtaggtgaaatcggtagcatccagcctgtaacggtcgggcaatgcggggccgcaggagttggagcctaggccggattgagtgtagtccaggcaaagaatcgttgatgcagcctcttccagctcgtagttgtgggctttggtggtcagctcctcctgggtgtatggggagaggttgaaagagaaggggtgctcggacaggaccgtcagggcggcgtccagggactccacttgcaggtagtcgcaagcccagtgcgagccgttttcctggggtttcaggtagggctcgaacaagcccggggccgtggaggtgaagacgccatagtgggcggcttggtgcttgtccgcgtaggactcggtagggccgtagccgcaatagctggcgcggttcatgggcttgggcaggaagaggcggatgccgaaccggggcaggaaggggaaggcgggggcgcggcggacgcgcatggacaggctgagcgcgccctgggcggtgatggaccagtccgcatgaatgcgtgcgattggttggatcaccggggcgaccaggagcatttcggaactcacgctcaccgttcccgtgcggggatccagggcagcctcggtctgcagggaacgggcgtaggcgcggtcatagccagccttgcgccactcctgcttgacctgggcatcgttgtctgtgggggcccgccaaatgttgagtcccatgggccggtccaacaggtgacggttggcgaagtccatagacgcgggcagaccggtgcgcttgtcgaaggtgtaacgccagccttccccttccaccgccagcagtgaagaggtctcccccaaggtgggcgtagagccgctcagacgggtgccggagagaggtgctgcgactgagcctaggcctgcagcggagctcgaaccggtctgaggagctgggtcatcgccggcgctcacgtcaccttgacccaccgaggactggaagcggtcagctaaggccgtgagcacatggttgctcctgccttctacagctacatccacctggtcgaagcccagggcgaagcctgccgggagtaagccttgaggcttgttcagccggtactccagcaggagggtcagcttgccggtgtctggcaaaggcgagtcaggcagtcgcaggagcccttggcccctcggctcgattgagggcacgggaccgcagtcgatggcatcgagcaacaggtcttctgggtcgacggacccaccaagggcgccgcttatgctggtgctggcatcgccgccaccgacgacatcagccaagtcagccccttcctcgaagcctgcaacatcatcctcgccggcccaccaagtcccctgcccgaagtagccacgctcgaagggctcaccgtcgcgcagcaaggtccaggaaatcgtcagatagtcagcgaggttgacgaagtccatgtaattgtgcagggtcaacgtgcgtgaatcctggtcaacgtccaccaccctggcggggcggaagacgttcttgaattccttcaaacccgtgcgcggcctccggtccgggtagaccaggccgtccatgcagaagttccccgcgttcgggtattccccgtgatcgccgccatagaggtagattttgcgcccgtccttggcgcgcccggcgtcgatcgcgtggtcgcaccactcccagacgcaaccgcccaggagacctggatgccgttggaaagcctggaaatagtcctctaaatcacccgggccgttgcccatagcatgcgagtattcgcacaggaagtaaggccggctcccccgctgcccatcgtccccgttggaggcgaccgcccaatgggtgtgcggcgtgtgtgcgccgccggtctcgaagtagtcgtcaatctgctcgatgctgggatacatgcgcgagtgaagatccaaattcgagtagtccaacccctcacgcgcagcgccatgaatggcggactcgtagtgggtcaggcggctggggtcccgccgcttggtccaggccagggcccgttcgaacccgcacccatagccggattcgttgcccatggaccaaatgatgacgctgggatggttcttgtcgcgctcaacgctgcgctccacccggtcgacaatcgactcagcgaaggcgggatcgtctccgatcaaaccattccagtggtccgcctcctcgctcccctgctgcctgtagagcgcatcgatgccgtgggcttcgatgtccgcctcggcgatcacatagaagcccagctggtcgaagagggcgtaataatgcggagcgttcggataatgggaggttcggatggcgttgacattatgctccttcatcagtcgcaggtccttcatcatctgctcctgcgatatgacgaagcccgtggcaggatcggagtcgtggcggttgaccccgtgaatcgtgataggcagcccgtcgaccaagaccacgccgcccttgacgctgacctcgcgcagtcctacgtagtcggtgataacctcgcagggctggtccgcggccgaaccttggggctgcctggcaggcagcgaactcagctccagccgatagaggctgggctcctccgcattccagagaacggggtgttgcacggcgaactccaggtgggacttgccctgctcatccgaggccaccgcctgggcgcggcccagcaggcggccgtcagggtcgtacagggagccttccacctggcaggcctggccctgatccgcaccgctgcccgcagagacgtcggccccttgcgcacgcaggaagtccaaatcaaccctgaccgtggctgagccgaaatcgccggccaggtcggtgcgcacgaaatagtcgcggatgcccgcctgtggccgacgcagaatgtagaccgagcggaagatgccgctcatgcggaatttatcttgatcctccaggtaagagccgtcgcaccacttgagcaccagcacggccagccggttgcgcccgggcctcaacagccgggtgacctcgaactcggaagtggaatgggagacctgactgtacccgacgaatgcgccgttaagccagacatagcagcaggagtccaccccctcgaagttcaggaacgcgcgaggcgccttggcattgggctcatagtcgaaatctcgcagataaacgccgcagggattgtcctcgggcactcgcggcgggtcgaaggggaaggggtattcgacgttcgtgtactgctgctggccgtaaccttcgcactgccagagtgagggcaccgggatggcttgatagaggccggggccagcgtcctgggcggtgtcgaagtcagcttggaagaaggccctggagccgtccgcggcggcctgggacacgtcgtcgtcgagcgcatggatgctcgggtagtagcggaaggcccactcgccgtccagcttgaggaagcgcggtgagccctcccggcgctcaccacgtcggtctgcgccgatctcatcgggcacgaagtacgcccgaggcgtttcgcagcctagatgaagggtggaaggatcctcgtagtagcgcttgatgaacatgccacttccccgttttgtcgtcgaaccgacccgccaagagcggactggattgactctaaatctaccggcatgggccgactccgataaatcagcgagtgctgggttgaaagcatgcggtaacgctgttactatataaacaacgttacattcggactgagcggtccaccgcgcgcaaggaggcaggcatgagcaaacacgccaccttcggcgcaccatcctcaatcgctgaagccaaccaggcacgcatcgcccggctccttcaccagtgtggaatcctctcccgggcgtacatcgctaaggcgctagggctgaccgcgcccgccatttccaagctggtggcccgcatgatcgagtcggggctggtgaccgagaccggcgacctacctggagcccgccaccgccgttcaatcggcctggcgctcaaaaccgccgcgtacagggtgattggcgtcaaattcgccagaagccgggtggattggggcgttttcgacctggctggcaaacccctgcagcagggggcactgccactgatgagcgatcgcgatatccccggcaccgtccaggccgtcaccgtccaggtgaaccaggtcctggcggccgacccctcgatcatcgccgtcggcatggccgtccccggcccctacctgcgccacgaaggacgaatcgcgctggtcacctccatgcagggttggcggggggtgaacttcctcaacgaattcagccaggctttcccggtgcctacattcatcgagcaagacgcccgggctggcgctctggcccaaaacctcttcgcgccggaccaccggacgcctcgactcaccggtccgaacggcccggccgcgcgccccaccgccgccacgaaccttgcttactatctcgtgggcgagggcgtggggcttggcgtcattgagtccggccgcctcatcaacggcgagcgcggcggcgcgacggagctgggccacgtctcgatcgacgtgaacggacggccgtgcgagtgcggcaatcgcggttgcctggagcgctactgctccgccgtcgccattcatgaaaccatgtgcgcgccggagtactcaggcagcttcccccaggtcggtggcttggaccacgcccaggcctgccagctcctcttccaacgagccgcccaaggcgacgagccagcgagcgaactgctggagcgggtctgcacctgcgtgggctacgggtgcgtatccatcatcaacgccttcaacccctcacgcatcgtcatcggcgacctggtggctggagccggacggccattgttggacaccgtgcggcggatcgtaagcgaacgggccctgcccgagcttcggcaaagcacccgcatttgcctctccagcctgccagcggacgccaccctgctcggggcggcggcggtagccgtcgaccgtttcctccaagcgcccacagcatatgcttcgctaagcaaacagcgggcgggcaaatcggggcacaaacccgtgatacgtccagcgaaggagagccaaccatgacgtaacgcatgacgaaatccacgaatacaggaacggcagagcgcgaaaacaatggtgagcgacgagcagtgaacagcgcagcgcggcacagggcggtgagccaagtccggcgcacgacgcggcaaggaaaggaaacccgcaatgcagcaaccaatcgtactgagcctcggggagattctgtgggatgtgctcccctccggcaagagggcgggtggcgccccggtgaacttcagctaccacgccagcaagaacggcgcacaaggatacgcaatcagcgcggtaggccgagacgagctaggccgggagcttgaggacgcggtcgcccaggccggggtgaaggccctgctccaacacaataagtggcccacttccacggtggaagtgcagctgaccgagggcatcccccgctacgtcttcaaggaggacgtggcctgggaccacatggagctgacggatgagctggaggcgctagccggtcgagccgacgcaatctgctacggcacgctagggatgcgcagcccgcagtccaggcggaccttctgccaacttttggaggccacccgccccgacgccatgcgcttctttgacatcaacctgcgcggcgcctactaccgcaaggatttaatcgaacagctgctgggcatggcgaccatgttcaagatcaacgacgtggagctggtcgtcctgcgcgacatgttccacatcccgggtgagagcgacgccgaaccggtccgctggttcttcgaccactacgagatggacaccgtgatcctgacggccggcggcgactactcgaccatttttctgcgggacggctcctcttccaagctcaacaccccgcacgtcaccgtggccgacacggtgggagcgggcgacgccttctccggcaccttcgcgaccaaccgcttggaaggcaagtccctagcccaagcccatcgggcggccgtgaacaccgcggccttcgtctgcacccagtccggcgcctggcccgcctaccctgagcaaatacccgactacctggcccagcagggcgagtaaacctcctgaacgaccagcaagcctggatttggcactcaggcctgctggtcgaagtaggacagggggtcgccaatgaagcggcgtagccccatttcagcggctcctttgagagcaggttgacgggcctctttagacatcatgacccgcggcttgatccgatccctggccaacacttgggaggccaaccggtcctgaaggctttgagccagaacgccgccgaatttggaccagaagccgcccaggatcacagtgtccacatccgaatagttgatggccgaggccatgaccgacaccagcgcgtccagggccctgtcaatcgcgtcggccgcttcggcatcgccctcctgccagcgccggtaaagctcggtcgcggccttggggctgaccgcatcatcgcccccagctatacccgcagcttcaaccaaggcccttctacctgcgtaagtttccaggcacccacgccgcccacagcggcacgtggggccgtttaaatcgaccgatacatggcccagctcgccagcgaagccgtgatctccaggctcgacggcaccgccgcgcacaaccgcgccaccgatgccgatgtctgttgagatatagataaaggaatcggtaggggtcagcggcttggaggcaccttcgttgctggctttgggcgctggcctgggagtggcgtaccccggaatctgcgccaaggccgccatcttggcctcgttgcctaccactgggtccagtcggcgcaccagcctgaacctgcccaggtccagacgttcccagcccaggttccgcgccatcagcaggagtttgccatcggcgaccaggccaggcagagccagtccggcgcccaccatgcggtagccatcctccgcgaggccgctttcaatgggccggctgaggcagtccaacttggcgaaaatgtcgtcagggtcagcctggcgcatgtcatcatccacccagaccgtgttgacaggccgcccagacaaatctaaagccatacagccataaccatctgtattgacctgcagaccgatgcccgcccagcgcccgggcgcgatggccaggggtttgctgggccgcccgtaagtgatttgcgaggcgtcaggctcggtctcgcgcaccacgccctgggccagaagcatcccgcccagcaaggacatggtggccttggtcagcccggtgaccttggccaggtccgcccggctcaagggcgttggcgcgcgcaagatgctatcgatgatgaccgaaagattgtggttgcgcaagtcctcctggttgatgctgcgcagtgaagtcatgaatacgcctgtcccttccgagccgcggcccgcatcgcgccctgctctccatattctcacaccaccaagtcccggcgccgccaaactccttcatagcggccaacgcacctgctcgcggttgccaaagtcacccccgaatagcttttaattcgacgattgaacaattatcctgaccgaggcctaccatagctgataaggcatggaccagaacgcggcaaggagggtgtcatgggacggatactggtagcaggcgtggacacatccacccaatcctgcaaggtgcgggtcagcgatgcggcgaccggtgagcaggtgcgcttcggacaagcccggcacccagagggcacctcggtcaatccggaagcctggtggtgcgccttccaacaggcagcgacacaagccggcggtctagacgacgtatccgcgctctccgtaggcggccagcagcacggcatggtgctcctagatgagcgcggtcaagtcctgcgcgacgcgctactctggaacgacacccgttcggcaccgcaagcccgtgtcctcatcgagcaggtcggccaggcgccgattgacttcaacaaccccaccgaagccgacttctcccccgatcccatccaacgcggccagcaacgctgggtgaaagccgtcggatcctcccccgtcgcctcgctgaccatcaccaagctggcttgggtaacccagcatgagcccgaagcggctggccgcatcgcggccatctgcctgccccacgattggctgagctggagaatcgccgggcatggtccggccagcgcgcaaccctccgcaggcgtaggcttggacgcgctctgcaccgaccgctcggatgcctcgggcacaggctacttcgattcggtatccgactcctacaggcgcgatatcttggccctggccttgcccgccgaactggcccagggcgtgttgctgccacgcgtcttgggaccacatgagaccgcctgcctggctgaccccgccatcgccggaaggaacgtgcccggcggctgcatcatagcccccggcggcggcgacaacgccatggcctccttagggttgtcaatggaagtgggcgatgtctccatatccttgggcacctccggggtggcggcggccatcagcccggtccccgcttacgacatgagcgccgcagtgacgggtttcgccgatgcgaccggccactggctgcccctggcttgcaccattaacggctcacgaatcctggatgccggatgcgccgccttaggcgtggattacgaaggcttagcaaacctggcatcccaatccacccccggcgccgacggcatcacactcgtgccctacttcgatggcgagcgcacccctaacctccccgacgccacggccagcctccgaggcatgaccatggccaacaccacgcgcgagaacctagcccgggctttcgtggaaggcctcctatgctcacagcgcgactgcctggagctgctcaaacgcctgggcacgagcgtcaaacgcatccttttgattggcggcggcgcccaatccccggccgtgcgcgcttacgccccgcagattctgggccagagcgtcctcctgccccagcccgaccagtacgtggccataggggccgcccgccaagccgcctgggcgctttccgactcaccccagcccccagcctggcccgtccgcatcgaaagcacgcttaccgccgcccccacccccaccgtctacgcccaatacacccactgtcgcggatgagcacctaaccgcaaaagaagcgatgcccggcaacacaaatttgcgttgccgggcattgttgatacagatggcaggacgatccacgccgtaaaaccatcacctcagattcaatgaccgcgggaacgtccgcggtgactaccggcctgcagcaccttccgcatcggattggccttcattttcgtcgcagtcggacgccgcagcagcatggcttactttatccccttgctgcggcgtattgcctgacgcacgcgtttcctctcgcttgtgacgtctccacaagacaaaggccctaccccctgtatatgcgctcgcagccgcgatacatagtgacaggaaaagattcgacgcactccacaaggacccatcaacataactgtctttcaccgactgcgccaaccagagtatgcaggcgacactggcgcaggcatacaatcgcatctgcatagtaatggttttcattgcatccgccctactttgagagggctgtatgtagccctacattccctgatattcggcagaagggttgccgcaccttcgcagcactggtgcggcaacccatcatattcgacaagcgggatcttatagaccccacaatcgccgttaggccttcttgcgcttgctgatcaagtcgtaagcaacagcggcgataacgacgagacctttgatcgtcttgactatggcggcatcagctcccataatcgacaggccctggttgagtacacccatgatgagagcaccgaccatagcgccaggaatcgttccaacgccaccggcaacagcagcaccaccaatgaagcaagctgcgatggcatccatctcgaactcttggcctgtcgcggcagttgccgaagccaaccgggacagcgtgattatggctgcaataccggtcaggagacccatgttcaagaaaatcttgaagtccaccttccgcgtgtcgataccggagagcatggccgccttgcggttgccaccgacagcgtagatgtcacggccgaagacagtgcggttcagcacgaaccaataaatgccaatcagcaggccgatgatgaccagcacgatgggaatgccaccctgggtgctattaccggagctggcgaagagataggtcgcgaatcctattgccagcactgcaatggcgcatttcagaatcacccagcccatcggctcggccgtcaatcccgcgctgatagctttacggcgcttgcgtatttggctgacggccaccaggacgatggctactaggcctacaacaatggtcagcccatccaatccaccccagaaaccgaagatgttaggtaggtaatccttagctatggcgcggaagggacgggactgcaacggtatggattctcctgcaaccaccgtggcaagaccacggaagatcaacatgccgcctagggtcgtcacgaaagcaggaactccaacataggccacccagaacccatgccaagcgccgatgaccaaccctatcagcaacatgaacgctacggccagaatccagttcatgccccagttcttcatcgcataggctcccacgcctccgatgaaggccacaacagagccgactgacaaatcgatatgcgtaccgatgattaccatgagcatgccgatagcggttatcagaacataagcgttctgctggaagagggccactacgttgttagggaagagcagacgcccgcccgtcagtatctggaagatgataataacgaggattagcgcgagataaataccgtacgagcgaacgttgccgaacaatagctccttaatggaggcttccttcggatcgctacctgatgcgccatttttccgcatctgtccggcactgttctcaggcgcagaaggtgagacggttgaggatgacatgacgaatattcctttcactgattatgagaacgcacgttggttcagacagcctgttgcataggctctttggatgtcatgaaccgcatcaactcttcttggttggtgcgcttagcatcaaggcaggccgtgatgatgccctgactcatggtgtaaatccgatcgcagatacccaacaattcaggcagttcggaggatatgaccaaaaccgcgctgcccttgtcggctagctgatcgatgatttcgtaaatatcgtactttgcgcctacatcgatgcctctcgttggttcgtcaagaatcagcagcttgggatttgtggccatccacttagcaagcactactttctgctgattaccgccagaaagattaccggtgggtacctcaatactcggggtcttgatacgcagctgtttgcgataatcctcgctcacacgcgcctctcgctcccgatctatgacaccggcatggctcatggctttcaaagatgccaacgacgtgttctcgcgtatggatttgatcaaattcagcccataagtcttgcggtcttcggttgcatatgcgactccgtggtcgatagccgagcgaacagttgggaacgaaacctcttgtcctcccatatacagatggcctgaggctttgacgccgtactggtgaccgaagatgctcatggcggtctcggtcctgccagcgccaatcaatccagcaagaccaacgatctcgcctgcccgcatgttcaagcaaacgtcctttgcaaccagacgttcgacgtccaatgggtgatggaccctccagttctccacccggaacacttcctccccgattgaggactcatgttcaggatagcgattagtcaaaggcctacccaccatgtcccgaatgagtagatcctggtcaagcggatgttctttgtcgatatcaacatgggaaatggttttgccgtcacgaatgacttgcacggcatccgccgattccgcgatttcgttgagcttgtgagagatgatgatggccgtgatgcccttgttacgacgcaaatcgtcgatgaggcccagaagatgcgcggaatcctcatcattcaacgccgctgttggctcatcaagaatcaacagtttaacattcttggtcagcgccttagcgatttcgaccaactgctgcttgcccacaccgatgttggctatgagcgtgtccgggttctcatccagccccacagcttgcagggcctctgatgccaccttccgctgagcggtatcgtcgatggccgcctctttcgtgatggggttgccgaggaatatgttgtctgtaatcgacatgtacggaacgagggccagctcctggtgaatgatgacgatgcccttggcttccgagtcccttatggtgttgaactggcaagtctgcccgtcgtacaccacttcaccctcgtagcttccgtatgggtacaccccagacagcacattcattagcgtggattttcctgcgccgttctccccgcacaccgagaaaatttgcccgcgtttcactgtgatattcacatcgtccagagccgtgaccggtccgaagcgcttcacgatatgacgcatctgcaaaatcacatcttgctcagtactcacattcgtctccttgtgcaattcaatggttcccgctcgcgccgccccgtaaaggttcggcgcgccgcgagcgggatcacccgctatcacatacctgcgtcagacgcggagatgtagccggaatcaaccagctccttcttgatgttgctcttgtccacggaaacgggcgtcagcaactgtgagggcacatccttgttaccgttgttgaacttgccagcggccttgggcgtcttgccatcgaccaaatccttgatcatagcggcggtggccttagccagcttgcgcgtatccttgtagaccgtcatggattgcttgccctgcacgatggcgcgcacattggccttttcagcatcctgtcctgtgataatcgggaagtagttccagcctgcgccctcgacggcattgacagtgcccagggctatagcatcattgggagccaacacggcatccagtttcgtgccatcgttgtagaaggagttaatgcggttctccatctccgcttgccccttctggcgatcccaattatcaatgccgatggattgccaatccttaacggagcctggcaccttgccggactttgccttgaacactcctgacttaaagtatggctccaacacagaccaagcgccttcgtaatagtatttagcattgttatcggttggagagccggacatgagttcaacgttgaaggggcccttcttaccttccttcacacccagcttatccacgatgtactcgccttgcatcttgcctacatcggtcagcgagaaagtcgcgtaatagtcgacagcatcggtattcatgattagcctgtcgtaagctatgaccttggcgccattagctgccgcttgctctgctgcagccccggtagccgtaccgtcaatggaagctataaccacatacttagcgccctggttcgccatattttgaatctgggaagactgaagatccgtctttccatccgcgaactgtaaagtgaccttgtacccatagctttccagttgcttcttcaggttgtcgccatcaatctgccagcgttccaactgctgctcaggcatggaaataccgatagtgaccttcgatgggtcaccaccggaagcagattcgcccgagcctcccctggaagcgccgcacgctgaggccggaatcaacaatgccacgatggcggcgatgccaattgcctttaccagttttttcatcgcattccctttcacctttgattaggagtgacctattgccgcaatagccgatactcattcattcggctattacacaggtatagcatattatttattgatttaactaactgctacgagagttgcctaaaagcactgacgtacgtagctgcatccgccttcctcgctcgtttaagcaaggactactcgcactcttccatccccaatgacgagagcgtggctgtatacagacatgccggacggcgcggcaagtaacagctaaatatactcaccgcgccgccgcagcggctcaggcctcggacaatgcctcgatcatgtagttgttgatggtggccttgaccgactccaggtgatcggcgtggcaggagtcaagcagctcggactggggcttgtcgattgcgtagttctccagggaggccagcgaggcttcgccctcctccacgctcttgccgatgcccgaatcgaaggaggagtagcgctgggcctgcaggttctcgatgaacttgtcctcgtgcatcttcgcggcgaccaggaggccggcggcgaacgagtccatgccgacgacgtgcgtgcggaagagatcctcaggggtgaaggaggtgcgcctgggcttagcgtcgaagttgagcccgccgtgggggccgatgccgccggccgccaggacctcccacatcaccgcggtggtctcatacaggtcggatgggaactcatccatgtcccaaccgatcagcttgtcgccttggttggcgtccagcgaacccaggaatccggcctcgcgcgccacacgaatctcatgctggtaggtgtgcatggccaggtttgcgtggttgccttccaagttgagcttgaagtccttatccaggccataggtgcgcaggaagttgatcgtcgtggccgcatcgtagtcgtactggtgaagggtgggctccttgggcttgggctcgatgaggaactgagcgtccatcccgatttcgtgcgcgtagtccacgcacatgtggaagagcttggccatatgatcctgctcgcgcttcatttgcgtgttccacaggttctcgtagccctcgcggccgccccagaacacatagttctcggcgcccaggcgcttgccgatctccaggctgtgcttcaactgcccggccgagtatgcgtagatgtcagcgaaaggcgacgtgcctgcgccagcctcgaagcggcggttggtaaagagcgaggacgtgttccacaggagcttgaccccggagtccttcatgttcgcttcgatcttatcgaccaccttgtccagattggcgtcggactcgcgcagggtctccccctcgggagcgaggtcgcggtcatggaagcagaagaattcaacgcccagcttgtcgaagagctcgaaagcgtaatccaccttcgccaaggcctgatccatcgggtcagtgtacttgtaatacggacggattgcggtggggtccccgaaggggtccaccaatccctgattgaaggtgtgccaccaggcgacggcgaagcgcagccaatccttcatcggcttgccggccaccaccctgtttttgtcgtaataatggaagcccagcccttcctggacgccggcggaccggcccacgtactcgatcttgtcaatgtcccacaaacccatgggatgctcctttgcacttggaaatcctggtgtgcggcgccttacgccccgtcatccctatggtagggcgctgactgccttttgtcaattcattgaattaaccatctgaacatacatttttcggatccgccaggaagaccaagagccgtccgccttcaggagtcagccccggctcagcgccgcccccaagacctcagcgacccgctggacttgttccgggtcggtctgctccacccgagcggacgcgcctccaccaccaggacctcctgaggaagtgaccagacggcgggcggacaggtggatggcatcgaccccggcggcgagcgctggggcgatcacctcaggcttcagccctccgcccgccatgatttcgatacgcccatcggcatgccccgccaggcgggtcaattctttgagccccagacgcacgctaggggcgccacctgaagtgagcacacggtcatagcccagcccaatcaaggcttccaatacttcggaacgatcctgggccgcgtcgaaagcccgatggaaggtcaagtccacatgccttccgaccaccgcttcctcgctcctgaccaaatcggccatgcgcgccgcgaattccctgtccaagccgccacctgggtacagggcgccggtcacgattcccgcggcacctgccctgatcgccaagcgggcatccgcctcctgcaccgcacgctcgtcctcgccatagacgaaatcaccaccgcgcggacgaatcaagacctgcactcccccaggcagccccaccctcgcgcagcggtcaaccagcccttcgcttggcgtcagccccccagtagcgcccaaggccatgcacagttccacccggtcagcccccgcgtcacgagccacgcgcgctccagccacgtcctgcaccgctatctccagcttcactgtcgcgcccgccatcggaaccgcctcccgccagaatcatccgcctccaaccatatccccaggccaggctcgcaagcaacgcggacaaggagcagacagcgcaagggcccggatgcgggcacttcgcttccgaacccatgtccgactagcgaatggcgcaagctgcggccattcggttcaccaaatgccgataaccttccaccagcccatgccgatagtcaggaagacaacgacggtcaccaggccgcagatcaaacctatgcgcaggaactccgatgtcttgacgtaaccggcgccgtaaatcagcgcagcgggcccggaagcgtaatgagtcatagcgccgatcaggcccgaagccacgcccagcatcagagccgctgcggtggcagggacgccggccgccacggccacacccaggaagagcgtgtagatggcggcgacctgcgccagctcggaggcgaacatgtagtggatgatgaagtagaagacggtcaggatggccaacaccagcatccagggcataccgtggaccaggttggcgatcagtttgccagcccagccagtgacgcccaagtcgttgagcggctgcgccatgccgaccagcacgccgaagaagatcagcgtggaccaggcggatttattggaaaccatgtcgttccaagtgatgatcttggtgcacagcagcacggcaacaccgaggaaggcgaccgtggtggcctccacatggaagattgaacccgtggcccagagcaccagcatcacgatgaaggtgaccaacatgatccactcatgcatggagagcggtcccatctccttgagctcggccttggcgtcggcctgtgcctggggcacgtgcttgatggtgggcgggaagagcttgtaaatcagcgccgggatggcgatcaggcagaccaggccaggcacgatgcaggccagggcccacatgccccagttaatggagacgcccgccttctgcgccagctggaagaccaccgggccagccgccatggcggtggcgaacatggccgaggtgatggcgttgacgttattggcggtcagggccaggaaggcgccgattttcctgcgggactcatccgacttgggggtggagtcctgcacgtcggaaaccgaggtgatgattgggaagaggatgcctcccaaacgggccgtgttcgagggcgttgccggggccagcaccaaatcggcggccgccaagccataagagatgcccaggctggacttacccagcatggagaggaagatcagcgcaatccgccggcccaggcccgtggacacgaacccctgggcgatgaagaaggccgccacgatcagccagatggagggcgaccctagaccggcgaacgccgctttcttgacatccaaggcgccagtaagcatgcccacggtcatgccgatgatggcgaccgacgaagtgggcagcggctggaggataagacccagaatggtgccgacgaacacaccgagcatgtgcatcgcctggccggtgagcccctggggcggcggaatcaggaagatgaccaggccgacgcccacgcaaatcagcgagcgcaccagctgcccggtgttaaacgcaggcttggcttcgggctcgacagcctgctgcttatctgtattcgacatggtgagctccttcatattcacacgtgtcatgcggatgccccgccggctgcgcttctttgccgccggccggaagaattcactcaccatatcctttagaatcagagcgcacaaataggaatcatttatatagtcaactcctcccacacgccgctcaaaaacgcacaaaagcgcgaattaacgcctttttgctcacattgaaatagcttatttgcgctcaccattcggcttttttaggctgctgggtatcaaggttgcgcgaaggggcgcgaccgtaaaccagcaaaggtgtgtgaatgatgaccggtttcgataccctcaatgactcctatgccaacaagggcctgcggttcaccgccgacgagcgcaagcagctgggcatggacggcctgctgccagcctccgtccagtcgcccgatcagcaggaaaaaattgtgtacgagcgcttcctccaggagcctaccgacctggccaagcgcttgtatctgatgagcatctgccgcacggaccgcaacctcttctaccgctccatggacaagcacctgaccgagtacatgcccatcgtgtacgcgcccaccgtggcccagtccatccagcagtacgacaagtactactccggatcggacgtggcctacatatcgatcgagcaccccgaccggatcggcgccgcgctggaccagtacgcccagggccgcgaaatcgacctggtggtctgcaccgacgccgaaggcatcctcggcatcggcgactggggcgcccagggcgccgaaattctgacaggcaagctagcggtctatacggccgctgctggcatcgacccctcgcacgtgctgccggtcatggtggacgtgggcaccaaccgcaaggagctgctagacaaccccgactatgtcggcaaccacatcgaacgggtgcgtggccaacggtacgacgacttcatcgaaaccttcgtgcaggagtccctcaaacgctaccctggcgcgctcatccactgggaggacttcggccggcccgaggccgccccaatcctcaagcgctaccaggaccagattctgaccctgaacgatgacatccaaggcacaggcgttaccgtgctggcggccctgctagcggcccgtcgcatctccggactggcgcccaaggacacgcgcacggtaatctacggcgccggcaccgcaggcgtgggcatcgccgaccagattgtggacgacctgattctgaaccacgggatggacgcggaggaagcccgccgttcggtcatgctcttcgaccgccagggtatgatcatctccgaccaggacgacctgaccgagggccaaaagaagtacgctcgcaccccccgcgagttcccggccatcaccgacacccgctcgctgccccaagccgtcgatgtcttccagccaacggtgcttgtaggcacttccacacaacctggagccttcacccaagaggtcgtcacagcgatggcctcccacgtggagcgcccgctaatttgcccgatttccaaccccaccgaactggctgaagccaaagcatcggacatcatcgcctggacccacggcaaggctttcgtcacgaccggaaccccctccgccccagtggattaccagggagtcacctactacatcggccagggcaacaacgcgctgatgtacccgggtatctgctttggggcgatcgtggccaaggccaagcgcatcagccgccgtatgttgctggccggcgcctacgccatctcagatatgattgatgccaaccagccgggcgcggcagtcctgccagcggtcaaggacctgaaggagatttcgcagcgggtggcgaccgccgtggcccagcaggcagtggacgaaggcctgaacagggagcctgtggcggatgtggccaaggctgtgattgacgcccgctggtctttcgaggactgacgaacagaccctcctgaaccaggtaaaacggatagtcgcgtacgtggcctcccctgagaagcaggggaggccacttgctttgggaactatgcggcataagtgatgggccccgcccacatcgtcgcgctaaccgccaaaatccggcagaggcaggcatctcaggacgctacgattgaaggtaggttcaggcccggcggccagcgaggggcgccgcgccagttgccgcgacagagaaccaggctaagccgggggatgctagcacgcatgagaggcaggtgacaaggatggcgcaggtagcgagcatacgcgatttggagcttctggccatgttggccagcaaccacagcttcaccgagaccgcctaccaggcccatatctcccaaccctcggtctctctggccatcaagaggctggagagacaattgggcaagtccctggtggagcgccgtcgtttcggggctggcggcatccagctcacagcggcaggacaggtcgccgtcaatcacgtcaagcaaattctggctgaactggacagcatgggcgccgcagtacgcgaaaccggcaggacccggacctggcgaatcggcatgcctcccatcatttcctccttgctggcttggcaatcaggcgaccaacccctcccttcgaccttgctgaccggccccgtctccctgtgcacggtcgggtccggtcgcctcctggagcagatgcgcgagcaccaggtcgattacgggaccgtcgcctcggtgcaggaccggctctcgataccagacgtcctgaccgtgagcatggtctcctaccctttcggactggcaggcagccacagcgctttggagcaactcgtcggcggcgagttcagccacggcctgcgcgcggacgacctggacgacctacccgagtcggtccgcttcgtgaccttgaatcatgagttcatccacgcgcaagccgccgaaagtctcctgcgccggcacgtgccggcctcccggatcatcgaggtcggggacgtggaaaccctgaagacgatcgccgaagccggcatcgcgttcagcttcatcacctcagcaggcctggagggaggagacggcctggaattcctgcccttcactgacccgaacgccccccagttcaacatcttcctcttccgcgaccagagccgctacatcgcgcccgaggaagaagccggcctcaaggcgttcaacgactacgcccggtgccagctctccgcctccaccccctcctgagcctcgggctcggcgcttgcgtcacctcaaaaccgggcctcgggatatcatcaggccggcggtaaaggattcggcccccttacgcgctagtatgagaacgaagggtgccatccgttgagagggcaacgagcagaaagagggcatgcacagcaatgtcaattcctccttctccccccaccacccaggtcccacctgctcccgaaatcgaggctgccacccttgagaaagagggaaagtcccacctgcgtccttcccgggtttggaagattctgctcatcatcttggccctggttggtttcctcatcgctcagagcgatgtcgtcaatatcccctccatcatcgcctcggcgacccactcccaaacccctaccaaatccccctcccccaagcacacgcacaagcctgcgccaacccctctgcccgcctcctaccgggaggccgcaatcaaagcacagcagtacgcggatagcatgcatctgtcggaagaaggcatccgcgaccagctgacctccaaacgcgataaatactcgcaggacgaggcccagtacgcgattgagcacgtgcaggcaaactacccggagaacgcgctcttcatagccaagcagctgcagtcccagggggtgcatgatcccgaagtcctgatgaaacgactgaccaacgcccactacaagttcacgccggctgacgccgagtacgcgctcgaccagcttttccccaaggagatcgtcgactcgatcctgagcgaggatcactaaccgcagcccgcgaagcgcgccctccctctcttgccgccgttcgtgcgcaagaccgcgcccgtgagcgtgcgcggaacgaggcaggatccaccccagcttgggacaaagcgcccgcacgagattcgcggtgctgactagagctgagggttaccgctggtcggcgccgtccacatccaggacgatcttgccgaagacccttcccccggccagcttgctgaaggcttgcggcgcttgatccagggcatatacggagtcgatgacggggtggatgccggcatgttcgacgaagcgcaggaggcgagcgaaatcccctaaggaccccatcgtgttgccaacgatacggatatcttggaagaaaacgcgggtcagctcggccccaggctggtcgccggtcgtggcgccgcacactgcgattacgccacccgggcgcaccgacttgaccgagtgggaccaggtcgcggccccgaccgattcgatgaccgcgtcgaccttgcgcggcagcctggcgccagtctccacggccaggtcggcgcccaggctgagcgctttatccctatggtcttgcgagcgcgaactgacgaagacctcaatccccgcagcgtgagccagctgcagggcggccgttgagacgccaccaccagctccctgaatcaggatgctgtcgcctggtttaacggcggctgcggagaagagcatggaataggcggtgagccagcttgtccctaaggccgcagcctcgccgaagctcaggttcggcggcttgggcagcaggtgggcactggggaccgacgcccgctgcgccatggtcccggggtagcgttcggacaggatgctgcgcctctcccccggccccaccccagcctggtcgccgccgaccagggtgtagaggacgacagggcttccagccgacagaccgtgtccgccgggcgctggaagatcctggtccagcacccctgcggcgtcggtgcctaggatcataggcgtggcgtccttggacaggcctacgccagccaggctccagaggtcgtgatggttgaggctggcggccttcaccgagacggtggaccacagttcgcgttccacaggatcgggcatggcccccaccttgagcatggagagcggattatcggcggatacaccgcttgcgtatacagccttcactggtcttccttccgttacggcgcccggcgctaaccataacttccgtcgcccgattcgactggcatcacagccacgcatcccactctaagcccgcacgccgaccgtcgcaggctggcccattggcccaacgggccgcgctccaataagccaaggcgggcagcatccaagcaagaaaggacttgattgacgcgttcgccggttcggtatcagggatacgatatcagcccaccaagagagggggacggacttcctactccagctcccacaaaccgcctcaatccttagcgctttgaggagcggcggcgctcacgctcgagctcgcgctcgcgggcacgctcacgggcacgctcatgggcgccctcacgctcgcgttcacgctcaagctcacggtcacgcgcgcgggcacgctcacgctcatgggcctgctcacgctcacggtcgcgctcgcgttcacgggcgcgctcgcgctcgcgcctgctgattcgttcagggcgctcggcggtcctgagacgatgctccacgttccacctatgccgatcgctgattcggtagtagacattggctatgccggccgcggtcaacaggaggacggaagcgataagcatagggatcatgggctcaagcctgaacccttcaagcagctcatacgcggacacggccatcttcagccaacccgcaagcgccacatagaaccaggcggttgccttgtgcatgaatcccatgaccttctcgcgctcgtgcctgcccttcgagagctcaccgagaatgccgacggcccgtttcctctccatatggaccttgatgatcggtatcagccaccaccaggccgacaccgtctggcgccgcttgctgaccctcccatagcggtccatgagttcgtcatactcccccaactccatgagcccctgatagagagggaacgtatacaggagccagtcccccaatagggacgcgaccagaatcaatcccttcacatcagcctccttatccgagcatccatcgatccaccgcacattttgatgaaaaacctgccgtatctacgggaaccagcctagaccatcagacatgcccgctcacgcaaatggttgtgtaggaccaggacgaatccgcgacgacggacaaaaccgtcatgatctggcggaatttgtgaaaatcagccttacgcgcaaagcaaataccatattcagccctgtttgattggcctgaattcagttttttagacggacggccgtcgccatatcagagctcctagcccccgatttcctcatcgacgcaagggatggggaaaagcaatccccgcaagcgtgaccaggcttccctgccgggcccaacaagctcatcgccgggcccataggctgggaaccgggccgaaaaagcctaggccccatggccaaccggctggtctacaaccctggaagcagtcaatggacccatctcaggaacggccatccctacgacatccactaagaggacgccacggcgccagaggaatgagtcacaaagcccaacagctttcggtacgcgccgcatcagagctgtggagcttcattttgtagttgcaatattggatcagggacgttgcgctgcaaaacaggcgatgggcttcatcccaatatggaaaccgaatgcatcagtgaggggacccatagtgatagtcgaccaccaccggacgccgcctgctggtaccgcatggcatcgcatcaatccaatcatgcttaccaagaccgtcgccccaaccagacaccctgacagcgcgactgatcacgcaacccgacctcggctcaaaacccaagacccacaaccacacggttaatccccacaaccccagaaacagaattccgaaacaccgcattcatcgcccatagtccgagacgaactaccctaacgtgctgctggccgctgattacgttggtgaaatagcgactccgcctggttcgttaccctgatttaagaatgggaataccgccatcataagcaagaccgggggccgctggactgtgccggtcccgtcttggtaagtcgtgccaggcttcttagaaggcactgcacagtgcattccggggggaccgttggtatccctatcgcactgcgcatagcactggacgccggagaaaaggcgcggttgactctcagtttcggattcattgtcgtttgacctgcttggggcaacccattcaagtccgaaagccgattgacggttgcggtcatgctgggagctgatgtcagcggagtgggagttgatcagatccggtcatattgaggtatacctgatggaagcctccagggtggtgcgggatgcgagccaacacgttttctttaagctacaggacaatggtaggaaaacgttatcttgtctcttgatggaatagaacggttcgccgatttgcccgcagcccattttcgatgatttacctccagcgcattcgaaccatctaagggaggcgctgtttccccttagcggcatcttggctactgcggggcgccaatccgatgcgcttgttcaagcccaaggattcgccatgctaccgacagactgcccccccacatggggtttggcggaacggtgaattcgctgtcttgtcgaggtttgcgtctgcccccacccgctgcaccgaagcagcgggtgagggcaggcaggagcatgggctcaccgctcttgcgccccaccgttcttctggtcgtcgaccagagccttcagaaggctcctgtcgcgttcctggataagggcctggctgtccgcaccctgccaagaatagaagccctgcccggtcttggcgcccaagtgcccctcggcgaccttagccttgagggtcgggtcttcgccggcgttgttgtccaggtcggcatacatgtacttggagaggccgtcgaagatgtcgaggccacccaggtcggcgctggctatgggcccgaggacgctccagcgacgcccaaggctgtacttgacgatctcgtccacggcttccggtgtcgctattccacggttgacgatgttcatgcattcgcggatcacggcagcctggatgcggttcccgacgaaccccaaggattcggtggacaaagccactgcgtgcttgccgatcccgttgatgagctcgacggtcagatcgaccgcggccttatcggtctccttggagggaaccacttcgaccaagggcatgagctgggccgggttccagaagtgcgccaccaggaagcgctgggggcgcttgaggacggtcgcgatggccgaggggctcagccccgaggtgttggtggcaaggaccgcctgttcggataccaccgattcgaccttggcccaaacctcacgcttgacgcccatgtcctccaggaccgactcgatcacgaagtccgcgtccgacaaggccgcataatccgtgccggaccggatacgatcaagaatggcttgccgctccgtctcctggaccaagcccgcctggatgaaggtgtcaaggtcatgctcgatgagggcggttcctctctccagggcttcttggctgctgtcgaccagcttgaccgcgtagccgttcatagcgaattgaagcgcggtcgcatgccccatggttccagcgccgatattgccgatgaccttgatatcctccacgttcatcagtgaagtcctttcttccgtgaatgcgtacgtctccatggtaggccttcgagaccatcgtccttccggcgtttgctgacggtgccccgctccatgccgcgccgacgaacggcaatgccacatgaaaaacgccacgcccctccaccgtcctcaccaaaggatgaacgccaccgaccgtaacccgcccaaaaccaggagaccgggcctggggcgggcggacccgacgactacggcagtcatggaccggaacggattccacggacccagccagacactccaacggctcgtaccggtggcacagcgaggcctacgcttaaaacccgcgtggggtcctccccgcatgcccaagacacggttccaaagcaccatactcatcgtccgtagcccccaaaccgagaacttgcccaatatccatcaatcgaatccatcaatcgaggagtcaaagcctgtgggaagtcatcgttccctcccgtccacggatggaaccaagtggagcgaaaccgagcagcgcacggaggaatcgttccctcccgtccacggatggaacgctctcctacacgcaaggcggcgcagacggctggggaacaccagctggcctaacctcacctagcctcacctaacccgccacacatataagcggccacgcttcgacgggattcttccgtgtgctgggcggctgtcgcgtttcccacggggcttcccctcccccggttattacggcccgccgtatgggaatctgcgttttgcatacagccgtacacttaccgcgcgcctggcgtttttcgtccggttcccgagggtatgaaaaagcccctgaaggctaatgtttccagagggctttcgctgtggtgcgccagacaggattcgaacctgcgacctgctgtcgagaaaggctgctgtatgcgtacatgctagctgcccttaactgttactaattacgcttagaatactgccgatactagcagattccaagtactaactgaaacgggtacgttagtgtataaatgtgcccgaaatgtgcccgattggattcggtcacaccgactatggactgggttcagcgtagacgataccccgttcagcgtaatctacgtcgaactcaggccatagctcacagcacaagaacaacttgttggacctcacggtctacaggagattgatacttgtccctgttccgcggagggcaatctcggacgtacactaaatcttttttgttcgtatgccttatttctgcggacaactttgccaaacacggagaaagcgggccgcaacaaagcggctcgcttcccgttctgacaaggctcccaaagctcttcgacaggtcatatttggacaggctggtttttagacgccagcctgttctccacaagcattgtggagcttcccattgaactggaatgggccagacgcgctgaacaatacgataagccagagaaaactatactcctccaagtcttggccgatatcactccgtgctccaaccatacccctccgagattaccaagttcactagcgtctcactgactgtggagacaacctcccacagtcagtgctgccgatattgtttgaaatcactgtttatctgggtgatgtaggccaagtagctcaacgtactttcatcaatcttgcacttgtcctcatgctcttcccatgtgcgataccacaaatcccagacagacggcgaaaaggacataaccgctttcgacctgtcaaccttcggctccaaaggaaattcccatcgcaaagcgggagaattctcatcgaaagtctcccgcctgacaacgtcctgtgccaggccggcggacatatgagcctcatcgttgacatgaaaagcatccagcagcgcatcattagactgatgaagcgcaaacaaagacacagcccaacacaacagataaaccagtccgcagcaaaaggccattttcaaacgtttcttgcgcataacttagagcctaattaatcagccttccattgcaagccagcccagctggtgtttgcaggagcacgtcgcacggattcactgaaaagcatatcgtgctgattccgtgacttctggcaaataaccgggacggagttcgcgcccgacgtgttccctaccaccaccatggcgtggttgaagccatcagggccgttgccgaggttcgcgtagataagcccaccccgccgacacgataaggattcgactcggaagtgaaagcgccggaatggtaacgcatataggtgtaattcatctgtgcgccagaccatgtacgagaggcgtgggcgatgccagcaaggttccatgtccacactttctcattcttcacatccaaagatgacccccacgccgtccgaagggcgccagcgtagaccgcctgagaaaggaaattagtgcaattacctccatgcccctcttccttgtatatcggaaagtctggattttctatcagtcgcagtccattgctccgcgtactgcatcatcctgatatagttcagaccggctttgttggtaaacatatccttcgcatatggtgccgaacgcatattgccgctaggcatcgaatttggggtattaattgcttcaggttccgttccatcatccgattccaacggatcaacaatttcatccgaaaccaccgaataaggggcaggattggatgaatccttaccaagggtaatgacatgccgatcagtaaagctcgaatcaaggtgatccctatgctcgccagcaatagtgatgtcggttcccgctgcaggaaccaatttcacattagacgtcatatccaccacagtctcatagccgtcacccacctgctcagaagacaccacactagtcgacacctgagcgtcatacaccttcatgccggcatcctgggcgacgtctttatacgagctgttctcggctgccaattgagactgcttatcctccgaaagcgtcctcagactaatacccgaatagctatcctttatctgtgacgcatacccacccaatagcacagaaatctgattccgatccagctcaggttcactagcacttgctgaaacaggagcaagcacaagcccgccaagtgccacaggtagagctgttgccaccacgatgctgacaactttcgctctccccatgttaatcataattaattctttctactagcatctgcggcagagaactcactcattgagaacctcgtcagcagacgctaccactatatcaaagtgtagttaaagccttgcttctttatctatagttttattatatctcttaaatatggtctagaaaaaataaaaaacgtttttcctctatcatagttaacagcaaagagcaaagaagcaatcatagtatggtaggaatcacgaaattcttgccctgaatcctgcataacctcacctgaccggaaaccgcattaatatgaggataaagtagcaaaacgtgggctttttggttggttgattccggtgtgttgggcctataggccgtgtgttgggggccatgcgcttcgtccggcccatcccttcctggtgtggagtccctcctcggcgatggtggcggtgccgtagggcgatggtcgctcctcctgtcttttcctggttgcgggtttgggtccttgcctcatgatggacatgggatcggggccggggccggccaggtatatggtccgttccacgatgcgtctcacgtgctcctcgctgcagccggtgcgcccgcgcacggcggcgttgatggacccgaccaggtcgctggtggcctgcacggggcccttgccagtcaggtcggggtcggtgaaggcgagcaaggatccctgtcggttgagttggtccaggcgcaggtgggcacggcgcggccgctcgtgggtgcaccgccacttcctgccggccagggccttggggtggtgggggtcccccgaggccagggccctctccttgatgctgtggccgtgctccaggtgccgatggttgagcagggccagccaggaggcggccccctgcgggggtcgcggatcacgtggaccaggcagcgctggacccgggtgccgggccagctcgccccgacctgggccaggcagcccctgtcgccgtcgcaggtcaggctgcggtgccttgcgcgcaccgggggcagggcgggttccaggtcccagcaccaggacacgcgcctggccagggcccaccggctcaccccggcgtccgcggccaggtcggccatggagcgcctgcccgacacccagtgcaggaacagcctgaaggacgccgagcgtccggtgccggcccggggcgcggtcgcgctcagggggcagagcacgggccgcacttccaccgctggctgcccaaggccgtccggcccttcttcctcatgggccttgcgcataccgggcacaacctggccctggctgatttccttctgaccatgcgccccagcgaaccagcccacgaagccaggcaaaagtcaagcaggcccacccatcaacaccccaaccattaacaccggcccgccacacctactcccacaaggcccaacaagcaccattagacccacattccgctacttaacccggactttctggggtgtccattttgtgcgcgttttcaccatgtaagcccttgtgccagtatgcgttgtgccaattcgaatgtgtctgcttggcttggaaggcatgaacacaccggattgccccgcctgcggagggaggatgcgcaccaacggcgccaccagcgtgggacgcaccagatggcggtgcgaggagtgcggctcctcgacgagccgcacctatgaccggcgggccgccgacctgaggagtggcctggactggctgttctccaaacggacgctaagcgagggcccggtcagcgcgcgcacccagcagcggcgcaaccgactcatgtggtctctgatgccgcccgtacccctggtctgggagcatcatgacgtggtgcgggtcgacgggatctggctgcaccggcgggccgtggtcctgatcgcggtggccgacggccatgtgattggctggaggatggcccggcatgaggacagcgtggcctggggcctgctcatgggccgcatcgccgcgcccagggtcctagtatgcgacgggggcggcggcatcgccaaggccatgcggcacatctggccgggcacgtccacgcagcgccgcctgttccacatcgccatgaacgtcaccaccctaaccggcatgagaccacggctcagggccggcagacagctgcggcgcatcgccatcgccctgagccacgtcaaggacggggaccgcatgaggcaatggctgctgggctacaacgaccgggagaccacgtggcaccagtggctcaaggagaccagcacccacggggacggctcccaggccgacacccaccaacggctggtcaaggcccgcaacctcctcaaccgcaggatcaaagaggacaccatgggcaccttcatcgccatggccgaccagtgccagagtcccgtacccacgaccaacaacctgctcgaatcatggaacaaacagctgagaaccatgctcaggaaccacaacggcctgagcctggaacgcgagacacgggccatctgctggtgtgccaccaacacaccgccatgccccaaagcgacgcctggctcgtcaacaacgcctacaacgaccaggacctcgaacgacccaacaacctcgcctggcaacacagccagcaaggcctgcacgcaaccaccggcatgcccgaacaccacgagccatcgactggaacgaattccacacacccgtcagataccccaacggcacagactaacccgcacacaatatggcgtataaccccaacacggtacggccggagtaagccaggagggtaccttgcacaagcaatgtgcccgaaatgcgcccgcgtccaaaaacaagaatggtcccgaggctgtgaagccttggaaccattgaattcttgtgcgccagacaggattcgaacctgcgacctgctgatccgtagtcagctgctctaatccgctgggctactggcgcatgttgctgtggcgataagctcaccgcgacaactcccctataatagcgcaaccccccgctctatccaagtgggtgtgtcgttggccgtcaacctgggttgcacgcgaaaagagcgcgtaagcagactaactacgaaccggttatccacttccaggcgatgacgctatagggatagcatagtgtttacctcattttcggggactcgggacggggggaaccgatgctgtatcaatgtggatgcggccggcgataaaacgagtaggggatgcgccggccttagaactaagggatggagcactgatacctatgcagaacctcacactcatgcacggcgggacggttaagcggggcatgtacgggcatatcgagacaggcggacgggtcttcgtggaacccggcactcattttcaaagtatgcatgtgaccggtgacctgatttgcgcgaacatatgcggtggaaccctggtgattgacggttccttccagctgccgaccggcgaactcaagaccggtagtctctcggggcaaggccgaatcctcggcgaaggcagcatcaggaccgcccggcttgatttcaaagggttgatacgcaccgaaggcgatatcgtcgtcaaacagacgttgaaattcaccgggttgatggaagggcagcgatgggtcgcggcacggcaaatcgacatcctgggcgttgtgcaggctcagaccatgctcgcctcgaacgtcacgataaggaacatgcatcccaaggtcgtgcccttggaacacgtcaaatggatggtccgcgcctcacgggtgccgatgatcatctgccgggaggcgaacatccatcgctgcggttgccacctgctccaggcgtatgaggccgagctcagagaggggtccctggtacgcgaggccgtctgcctgacgacgctgaccatggaccagtcatcagccgccgtgctgatccaaggcggccccaaacgcaaacacgtggctgggcattaaccgggcctatggtcaggcccgggtcaaccagagcaggtattcctcattgccgtgggtgccagcgataggcgaaggagctcggccacgcaccgagaaaccatgctcagtcgcgctgagctccacccgggccagggcctcctgccgccgcccctcctgccgaaccaccccgccgtggcccaacttgccgcgccccacctcgaactgaggtttgaccaacaagatcacttgggcgccgggacgagagactcgggcgatcaccggaatcacgtaagtcagggaaatgaaggagacatcggaaacgacgaactcgggctggaagggcaggtcgctcgcctcaacctgtcggatgttgactccgctaagctcaaccacacgctcgtcgccaaccaaccgtgggtccaattggtcatgacctacgtcaagggcgatcactcgctgggcaccgcgccgcaggagcacatccgtgaatccgcccgtcgacgccccgatgtccagacagagcttgcccctgggctcaggcaggccagaagcggagaaggcttggaaggcgcctaggagtttgaaagcgcctcgggagacgtaatcgtcgcccttgtcggcctggaggaggtccgtcggctgaaccagacgggagggcttgcggcagacctcgccattgacccggacagccccctgcctgatcagggcggtggcccgcgagcgcgaatcgaccagtcctcggagagccagaacctggtccaagcggcgggctggcctcgatgacggccattgttcgggagcggaagctgtcacttcaggcctttcactcatgcaagtcacgcaggcggttttgcaactcgcccaacaccgtgcggtaagcgtcaacctgctgttcgggcggcgaatcaacgaccgcccgcagttgcgggtagcgccggaagagggcctccctagcctcgtccacgcccgctggggacgccgccgccacgccttgggcggacggttccatgggggtcgcctctgcgctcatgacgccagcctcactggttcaggtggaaatcggggatgctcagaccgctggggtccaggccatcgtccatggctgaccagaccgcgcaggcagcggcgcgcaaagcatccagctgactggccggatcgagcgctttgccgttttcgtccacggacgttaacgtcacagccccgtcgtccaagcgcgcccgactgcccccgcaggtccatgccccgtcggcgtcggccagcggctcgggttgtggtcgcgtaaggccacggagatcttgggcgatataagtaggccgctgatccgggcgtgcggtgatgatcgcttgaggcgtcgccacgcccgtcaggacgacgagggaatcatagccaccgcggtcagccgcctcgatgtccgtgtccaagcggtcccctaccggcagggagtcggccgcggggaccggctcgtcgctagtagagaataaacggcgggcctcgtcgtatatggcgggctcgggtttgccagctgagtcctcgggctcctggccggtggcggcgatgaccggcaattgcagggcgccgttacctggggcgatgccgcgctccctcgggatggtcaagtcacggttggtcacgaagtagcgggctccgtgctcaatcgcataacaggcctggttcaggtcctcaccggtcaacgcggggtaccaagattggatgaccgcctgggggtcatcgtcgctggagtcagcgattcgcatgccatttgcgcggatttcgtcgcgcaagtggtcgcctccaatgaccagaacctttgcgccggcgggcaggtgcttgcgcaacatgcgggcgccgacgatgccggaggttatgacttggtcatcggacagcgcaaggccgaagcctctgagctggtcggccaccacggacgggtagcgggagggattgttggtggtgtaggccatcgccatgcctgcttggacggccgccttgatgccctgggccgcatgctccacggggtccgcgccccggtacacgacgccatccaagtccagcaaggccagccggtaggtctggctcagcggcaggtcagtacctttaaggaagccggcagtcatgcctggtcctcctgcgtccaatcctctccgctctccgcagcgggaatgttcgtctcgctcggcggctcaggctcggccccaggctccgacgcggattgatcaggcgcggcaggcacgcgcggggactcgctcacggcagattcggcagcgtcaacagcggccccatccgtagcctggtcgtccggctgttcagcatctggctcagaggttgaaccagcggattcggccgcgctagcccgggccgtgtcgtcctggtccggctcggcctggccgagtgtctccggcgaatcctcctggttggaagcctgcccgtcttcagcctcatcctcgccgccatacagcggtatgtccaggtcctccagcatggaagcggtggcgtgctccaggtcgttgtcgacgatgatctcctgctcttcctcatcttcgtcgctctcggcgtactcggcctccaagcgatccagaaccgggtccagcttgtgggattcgtcggcgcgtccgatctgctccaggaagttctgctcagcctggagggcccgcatcaggtaatcgccggacagacccttggcccgggccagcgctcgcacggtctcgatggctttgtcccacaggcccaggtcgcccagggcgcctgcatagaccaggaacatctccgctttggactcgccgcgcaactctttagccgcttcggacgtggcttcttcgacggccttgcgggggtggcccagaccgcgttcacagtcggcgatgaaaggcaggtagtccgtgtagccgttcatgcggtaggcggtacggaactccttgagggccagtttatagtcgccctgccggtaggccaccagggccagcgtctcgcgcgcgatgtccacccgggaggcttgcttggccacccacttggcgtgggccaaggcccgctcggggtcagactcctccaaagcgtaggcggccaggatgtgcaggccggtgttctccgcgtgctccttgctcaggccgcgcagccgcaccttatcgtccttggaaagcatggaccattccaagcccttgggcatcttcggctcgtccggcctcgggtcggtgtacgggttctgcgagggataagagaccgtcccgtccgagttgcggcgggggccatcctggaagtggtcacgcccgctgcgctcgaacctgcggtcttggcggcggtcagagccggaatcccgacgattctgccagccggaacgccgttcgccgtgctgctggtcgcggctccggtcgtagccgtggccttgacctccctgacgccgatcaccgtaggagcgatccctgcctccatcacggtaaccgtggtcgtcgccgcgccggtcatcacgacggaaaccgccacgcccatcgtcgcggcctcgattgccataggactggcggcgatcgtcgcgatcgtaccgcttgtagccaccgcggcgatcatcgccatgaccctgataacgtccgtggtcgttgccaccccggtcatcacgacggaaaccgccacgacggtcatcgcggtcccgattgccataagactgacgcttatcgtcacggtcgtaccgcttgtagccaccgcggcgatcatcgccatgaccctgataacgtccgtggtcgttgccaccccggtcatcacgacggaaaccgccacgacggtcatccgaatcccgctcgccatactgcttgcggcgattgtcatggtcgtaaggcgtgtaaccgccgcgcctatcgtcatgcccccggtagccccggcggtcgtcgcgcctgggcctgccgtcggagttcccgtggtcgaaccgctgcccgccgcgcctggcgtcaggatggtcgtagccatggccattggaacggccgccgtccgagccatgacccctataaccgccgtgaccttgtccttgcccgccgcggtggaaaccaccggaacggccgccccccgagtgcccgtaacccgagcgtgagttcctgccgtcgccgcctgcacggccgcggccgcccctgccttcgtctgtcatgtcacatcctcatagtcaaatggggccgacggaaccggcccctcgttcttcctcgcccagcgagctgcgtcagcgccgttcgagcgcgcccaaggccttcttgcccctacgtaccagggcgaaacggccgcttaggaagtcttcatcacccagctggcgcccctgatcatccacccgctcattgttcaggtagacaccgccggacttaatggttttccgggcctcggagacggaggcgaacagtcctgcgctcacggccgcgtcgaccaagcgatcgccggaagcggcctgagcgaatgccttgccgccttgcccatcatccaccatcagaccttgcagggccccttcgagcgtttcctcatccaagtcggtcaaagccgcgccacggccgaacaaagcaccggacgcgtcgaaggcgccctgcgccgccttatcgccatggacataggaggtgacctcccaggccaggaccctctgagcttcacgggccccaggattgctctggacctcgccggccaagcgctcaatctcggccttaggcaggaaggtgaaagtcttcagaagcttgaccacttcactatcgggctggttgaaccagaattggtagaagcggtaaggggagaacatggtcgggtccaaccagaccgcgttgccctcggacttgccgaacttcttgccctgggagtcggtgatcagcgggctggtcatcacttgcacggattcgccccgcaccttgtgaatgaggtcgagccctgaggtgaggttgccccactggtcgctgccgcccagctgaaggcggcagtcatagcggtcgaagagctccaggaagtcgttgccctgcaagacctggtagctgaactcagtgaaggagatgccctcgtcggagttgagccgacgcgccaccgtgtccttagccagcatggtgcccatgcggaagttcttgccaacgtcgcgcaggaagtcgataacgctcatggagccggtccactcataattggacacgaacctcaccgggttggagcccccagcttcgaggaaacgcccgatttggacctggaggcgcttggcccaacgagccacggtctccttggggttgagtgtgcgctcgcctgactgcctggggtcgccaatcagtccagtcgccccacccaccagggctatggggcggtgccccgccgcttgcatgtgacgcatattaagcagttggaccaggttgcccacgtgcagggaaggagcggtagggtcgaagccgcaataatacgtgacaggtcctccagccaagagctcggcgagcgcatcctcatcggtgcactgggcgaccagccctcgccatgtgagttcctcaaagagcgaatcgaagcccgcttccttgaaattggtgaccttagccatgagacaactgctccctatcgacgtgttcgtatatgaagtcgggacagccttattttcgcagatgaggccgacaccgcaagccttgcgcgcctggcgccaggatcaggtctcgggcttctccgcttggctggatgtcagattcaaaagccaggcgctgcgctcctcggcggctgcgtcgtcggcagcgataatcaggaccgtgtcgtctccggctatggtgccaagtaccccgggcaggggctgccggtcgaaggcgctggccgcgtattgggccgctcccgacggggtgcgtaccaccaagaggttcccggcccgcttgaccgaggtgatcagcccggtcagtacccgggtcaaatacgaatcggtcttattaggctcactgggcgaccccatggacacggccgccgcacccaacaggccctggtcggccgcatcgggaatccagtaggccagggcgccgtcggggtaccgaatcttagccgcgcccagctcctccaaatcccggcttaaggttgcctgagtcacttcaatcccttgcaaattcaagagcttgactagctgctgctgggaagtgacctggccttgttccaccagctggcgaatcgcgtccagccgggccgttttgcttgcaggtcgcacgcttgcctcctcgtcatgcatgtattcactgtacataccataccggttgacgaatacctatgcgccggcagccgaagcggcggaagccacagcaaggacgtctcaggtggtgagctggtcgctcgaccccccacctccctgaccaggcatcagggactgcatcatctgctggtagaaggcatcggcgctcatgccggacagtgccatccaagccaccagacaggtgtaaatcaggttgatgacgaccgccgccacggccagcccgaagcctttcatgcggaaggtcctggtccggtagatggcgatgccacccatcagggccgacagcaggggcaccggcaggaagagggccatgatgaaagcgatgaccgcataaggatcccaatgaccgtaagctgggttctgcgagggatcatcaaggtcgatgccattgagaaagcgcttgccatggcgcttccccggggcgccttgccccctttgcgcgtcccgcggcccctggtgggcctgcggcggctgaccgggacggccccccaaggccgcaggaacgggccgccgattgtcggactcctggccgccctggctggactcgggctcaggctgaccatagatgtaagggttccagcctgggtactggctggacatagcgccgtactcaggctctaccctctgcccataggcaggctggatagaagaagtggtctggccttgcgcctgaggctggccttgctggccgccgctcttgtaatctgtatccgtgctggctccttacgctcctcgcatcttaccgcgccaggcgcggcgggcggggccgctcatgccctaagccgagcgccgagggcttcggtcctctccacaatagccgcgcgcaccttctcgctctcctgagaggtgagcgtacggtcgggcgcgcggaaggtgaccgcgaaggccagggatttgaccccctgcccgatttggtcgccggtgaacacgtcgaagagctgaatcgactccagcaaatcgccagccgcttcctcaatcgcctcactcaactgggcggcgtcgaccgaatcaggcaccgtgaaagccaggtcctgcttgacgggcgggaaagtggagatgggcttggcttgcaggggcttgaaatccaagccctcgaagacaccatccaggtccagctcgaaagccgccgtgtgctccggcaaccccaaagcctggttgacgcggggatgaagctcaccgaccacgcctatagccctgccctctgccacgatcacctgagccacccggccgggatgccactgttggggggcatcctcagctgccggctgctccagccggtaatcggctcccaggcggtccaagacccgcctggcggattccaccgcgtcggtccagtccaccgggcgcttatcccccagccagccgtcgttcaaggcgttccctgtcagcagggcagcaacatgcaaacgctgggtgggcagacctgcatccaaagcgcgcagctcatcctcactaggcttgcggccgccaggcagggccggaatcgacggcgcctggggatcccgcagataaatggaacccaactcgaagaggcgcacatcctcgttgccccgacgaatgttgcgctgaaccgtattagccaggggcagcaagagttcgcggcgcaggtaagggcgatcggcggccagggggttggccagctccacgctgacctcccgtaggtcatcttcctcgtaaccgaaggccttgaaatcctctggtcctacgaaggggtagttcaggacctcagtcaacccgtactcggcgagggtgtccgccacccagcgctggcggcgctgctcctcagtcagccccacccgtccggcgacatgcggggagggcacgctcaccggtatctggtcgtagcccaccaaacgagccacctcctccaccaggtcgcaggactgggtcaggtcggggcgccaggaaggcggggtgaccatcagccgaccctcacccctgggctccgtcttgcaacccacatcagtcaggatatccacgatccgctcgactggggcgtccaaatcgaccaagcgtttgacgtccgctatggggaagtcgattccaggcaggtcatgggtccggtccacgtccacggccacggcgtccggctgagccgagccgtattcggccagcagatcggccaccatttgcgcagcggcgggttgcatgcgccagtccaccccacgttcgaaacgtttggacgcttcggaaggcagcttgtggcggcgggccgtacgggcgattgagaccgtgtcgaagtgagccgcctcaatcaggatattgcgggtctccgccgtcacttcgccgtagagaccgcccattaccccagccaggcccagcacgcgcgatccgcgcttaccctgcggggagtcggtgatgagcaggtcttccgggttgagctcacggtccttgccgtccagggtggtcagccgctcccccgctttggcccgacgcaccacaatcgggccctcgattttatccatatcgtaggcgtgcaggggctgccccaggtcaagcatggcgtagttggtcacgtccaccggcagggagatgcagcgcatgccggcgcgaaccagccgacggcgcatccagttgggagtgggcgaaccaggctcgtagcctcgcacagcgcgcaggtagtaacgatcgcaacccggctggccgtggatgggcgcctggtcgtcgatctccacttgaaccggagcctgagaagcgtcggcatgggcgctcagcttggcgtccagctcggccaccgggtcggtgtaagccgcgcccgtcgaatggtggtactcgcgggccacaccccggtaggacagggcgtagccacggtcgggcgtgatgttgatctccagcaccggattgttcaggtgcaggagccccatcgcgtcatcgccgggttgcagcgccgcgcactcctccttggtaaaaccgtacttgcgcaagaggatgatgccatcatggtccgagcccagccccagctcgcgctcggaagcgcacatgccgtccgagatatgcccataggtcttgcggggctcgatgcggaaatcaccaggcaggacggcaccgggcagggtgacgacgaccttctcgccagcggccatgttgggcgcgccgcaaacgatgccgcgcggcaccttgttcccggcctcgtcaaccgcgttgtaaacagggcccacgtcgacctggcaccagttgatgaccttgccgtttttctggggttcgggttcggcggagaccacgtagccgaccacgatcgggccggtgacggtggagcggtgaatctcctcctcctcaaggccaaccttgacgaggtccttggccaattgttcataagtcaggccttcggggacctgcacatgctctttcaaccaatcaatgtcaaccatcggcatgtctgaatcactcccccatcacgaattggtcgctgaagcgcgcatcgccctcaacgaggtcgtgcatatcgttgatgtcgtgacgcaggagcagggtgcgctccatacccacgccaaaagcgaagcccgagtaccgctcagggtcgatgccggccgagcgcagcacgttcgggttgaccatgccgcaaccgccccactcaatccagcctgggccacccttcttgtcggggaaccacagatccatctcggccgaaggctcggtgaaggggaagtaggaggggcgcaggcgggtcttggcgccctcgccgaacatggccacggccagcttgtcgagcacgcccttcaagtccgccatcgtcaggccctcgtccacggccagggcctcgcactggtggaagaccggggtgtgagtggcgtccaactcgtcggtccggaagacgcggcccgggctggcgatgtagagcggcacaccgcgctcaatcaacccgcgcacctgatcgctggacgtttgcgtgcgcaagaccaggttggagcccacgaaccctgcggcgtccttggcctgattgcccttgacgtagaaggtgtcctgcatctgcctggccgggtgatcagggcccaggttcagggcgtcgaagttgtaccactcgctttccacctcgggcccggaggagatctgccagcccatggagacgaagaagtcctccacgtcctccatcagcttggacaaggggtggcgcgcgcccagcggccggcggtccaccggcagggtcatatccacccgctcggcctgcaacttcctgtgctcagcctgggcctggagccgctgctcctgcagaccgtaggcgcggccgaagtcggccttgagcgtgcccatcagctgaccggccgtcttcttctgatcgccaggaagggagcctatcgcccggctggcctgcgccatagctgatcctggccccgcgtacttgactttgagggccttgagctcctccaaatcggaagcttcgcggacctcctggatgccttcggccacttcatcggtcaccgcggccggatcgaattgcgcatctgccaacttgagcccttccccgcagggaaaaccccacgaaaactgccgtcattccagtcttttcactgtggtcacattctttcaagacgactcgacatagccagggcgtaaagcatgaccgcggccgaagtcgccaggttcaaggattcggcgcgcccgtaaatcggaatcgagacaatcgcgtcgacgcgggccagcacctcctcgggcaaccccctggcctcattgccgaagaggacggcccggccggcggcgccggagggggaccgcgccaggaagtcaggcaaggcttggggctgacggccgtgcgcgccataaatgtccgcggcgagcacaggcaactcccagccacggcagcgaacgaagaactcgtcagtgctgacaggcagcacggggatgtgaaagatggacccggccgtggccctcagcaccttgggattgaaggggtccacgcactcatccaccaggagcgcggcctggcagccggcggcgtcggcggcgcggatgacggcaccggcgttaccagggtcgcgcacctgccaaagcgctgcgatcaaggtttcattgtcatcggcggccgcttctgcgccctccccccaatcggcggcgagcgcgtccaggtcatcccgcatggcctccagggaccctacgcccacgatgccttgggcgttcttggatatggcctgcatgaccctgcttgtcacataatgcacgtacacgcccggggcctgggaacgcgcctggtcgcgaatcgcggccaccgcgggactgaccggctgcagcccatcgccggggcctacctctatgtagaggtccatgagggcgtcggggcggcaagccacggcctcgcgtgcgcactggggcccttcgatcagaaaacgcccgtggcgctggcgttggcggcggtcggccaaatcgtttacgcgacggaccctatcggagcgtggattatcgatgacttcgcggttttcgggcataggcccactctagcgaccgtccaggccaaagccgcgccatgccacagcgctgccgcatgcagcgcatgtggcatacatcacggaagaagcaggctctgcggtcttggcaggacccgcctttgctgataggctatagggacaagccaaatcgacttgcgtgatacagacatgctctgtcctatgcgcgtcgagcgaaggcgctcatacggcgacatctcaagaataaaggaggcgttcatgcctgtttatacactgcctgatctgccatatgattattcggcccttgagccctacatctccggcaagatcatggagctccatcacgacaagcatcaccaagcctatgttaatggcgcgaatcaagccctggagcagatccacgacgccgccgaatccggcgacgtggcccagtccaacctgctggagaagaacctggccttcaacctggccgggcataagaaccacaccatcttctggaagaacatggctccagccaacgatcaagagcctactggcgagctcaaggccgcgatcgaggagcagttcggcggcttccaaggattccagacctacttcgagtccatgtgcgcaggcatccaaggctcaggctgggctgtgctggcttgggacgcgttgggcgagcgcttggtcactctgcagatgtacgaccaccagggcaacctgccggtcaccatctacccgctggtcatgctcgacctgtgggagcacgcctactacctggattaccagaacgtgcgggccgactacgtcaaagcctggtggcacatcgtcaactggcaggacgcttccaaccgcttcgacgaggtgcgcgccctgaacaccaccctggtcaaataggctctgttcaagctcaactggcaaggacacgctggactgccgaccatgtcattgtcgtaactttggcgaaagcccgccgcctaggccgcaaggcctgggcggcgggctttcgcctacctgggatcagccgccgaagaaagcgaaactgccacagaaccaggccaaggccaggctgaccgccggtatggccaggcagatggccaggaaggcccagtcgcgcgggtggacccggctgaccctggcatgggagcgcgggcctgggccaccgaaaccgcgcgcctccatcgcctcggccagggtcgtggaccggcggatcgacaggaccagcagagcgaacgcctggggcaggaaggctttgaccttgttctcgtctcccagcccacgtgagcgtcgggaggccgtcagggccgcccagtcgtcctgcaggaccgagaagaggcgcagaccggccagcccgccgtagacgaaacggtcgggcaggcgcaggacttggctgaaggagtcggccaggtctgtggcatccacccccagcatcacaatgatggccgggatgccgatggccaggatacgcaaggccgtggcgcccgccagttgggccgagcgctcggtgacgcgcatgagcccccactgccagagctgcgccccgccggacttgccatacaggagaacggcgatggccgatccaggagcccccacgaagaggggccacgtggaacgcacgatcctccaaggcgtgaagcctgcagccgtcagcaggaccgcctccatcaccagcgcggtcagggccgaaacccagtccaggctgaaaaggagcggcagggccagcaggaaggcgccgatcagacggatggaggggttgagcgaggcgatggcggccgaccgggaggccgggcgcggatcctcgatccgctcgcccatcgcctccaccggcacgaccaccccgcctggctctgcgcctggagcgcttgaggcgttcgaagggccgccgaacggctcctgagcgtcgccccctcctgggaatcggtccaggttgcgggtcgtccacacggcggaatccccgcgcgggcgcagctcaatcacccgggcgcccagggcctggacgagctcacggtcgtgagtcaccacgatgatcgaaaccccttgggacctcagggcggcgatcagctcggccatgctcgcccaggtggcccgatcctgaccgaaggtgggctcatccaggatcaggacgcggggggcggccgccagggccgaggccacggtcagccgtcgtttctcaccgcccgagagcgtgtaggggttggcgtgggcgtactggctcaggcggaatcgcttgagcaaggcatgggccgttttctcggcatgccctcgatccaacccggaacgcagcggagaaagcatgacttcctccaggaccgagccccgggcgaattggtgctcagggttctggaaaacgtaggagatgcggctggccaggtcgctggaccgccaagagccgggatcagggctctggggcccgtcttctcctcgtagaagggctgatgcctccacctgtccggccaccggttccagcaacccagccagggtcatggccagcgtcgacttgccagccccgttgccgcctaccagggcggtgatttggcccgccctgaaatccagattgatgccctgggctatcgcggcgcccttgcggcctatgaataggcctttggctgacaggagcggcggaccggcaccctgatcagctgggtatgaaggctcccccgccaggtgaatgggcttgaccgcatcctggggccgggcatagcgttcaggcacccagacgccgagtccggcaaaatccaaatcagcgcggccgaatacctggcatggcgaaccgtcggccaccacgagcgtgcgcctgaagcctctggcgtcttctcccccgtccaggcccaacaccaccacacggtcgatcatgtcgatccaaggctcggcgcgatgctcaaccaggagcaaggtcgatcctcggcgctccaggacctggcggaccgcgcccacgacctggccgacgcccgctggatccaagttggcggtcggctcatccaagagcagcacgcccggttccatggccaaggcgcccgccagggccagccgctgcatctgcccgccactcaagtgggtgaccgaccggtggagctggaggtcctccaggcctacggccgccatgctgttttgcacacgcgaccatatgcgctcccggggcaggttcatgttctcgggaccgaacgccacattatcgccgaccctctggaagacggcctgggcatctgggtcctgcaggaccaaacccactcggccccggccctggtcagcgggcaggccatcgatcaggatccgaccctgccgcagcccgccgtcgctgtcctccaccgcgaccccttcgcccttcccggcatcgccgcccgcccccaagagcccagcggcgccctggaggagggtggacttaccgatgccggaggctcccaggagaaggacccgctggccggccgggatcttgagattaaaatcctggacggagaagtaggagcgcgaggcatgcttatacccccatccccggaattccaaggatgctggctggcccaggggggcgagtttggcgctcatggctccgcctcctgccgggtcaccgacggtccgagcgcgccaggcggccggactcgaaccggtccaaagcgccggtatgggcgatcgccaggtaaaggcgccaaaccaggaatcccgcgaagagcaggcccgaagcgagcgtcgtcaggaagcagaccaggccgtagggcccggtgagtgagatggcctgcaggttggtcaggaagacgtacagccagcagccgacagccgaaagggcgccggagagcagggtggtggccaggttccagacccggtaggcgaagaaaaggaaggccagctcggccatgatcccttgcagcaggccgataaggaaggtttcaaccggcacccattggctgcccagcaaggcttccagcacggccgcgacgacctccgcgtacacgccggcgccgggcttgcggacgatgaccaaggccaggggtccagcgaagagccaaaggccgttgaacaccccagccaggccaggaacgatcccctccaggatcggggtgggggccgccacaagcatggccaccagccagtaaatcaaggccgaagccacgccgatgaccgaggccaccgctatatcggccacccgccagcggaaacgacccgtacgacttggggttgaggaagtcgggggctctcccccgtttgaatacgcttgcgccatgatatgtgcctttcgtcgtatcgctccgccgttcgcggcgcgcatgctaataaggcacgggaaagtgacatccgtgcgccggcattacccggtatacgttcgtccggttgaggctgggcctcatctcagccgcacgccgccgcacccgcaggtccggtagcacgcagcccccgtgtcagctcccatactagggcgcgggcttgtcaaacgggggctgtgcgcaggtcgtgcgttcaggcttcggtttgggccaatttatccaggatcaaggcctcggtgacgatgttcttcttcagctcgctaaggctgatggactcgttcgggctatgggcgttggcctgtgggtcctccggtccagtgaccaggacatcggcggccgggaagatgcgcttgagctcagggatgaaggggatggagccgccctcgcccttgttgaccgggggaacgccgaatgcctcctccatagcctcctcggcaatcttgaccgcggccgaatcggcgtccatggcccagcccatgcccgcgtcgacttgctcgacgctcacctgggcgccgaagggggcgtgggaaaccaggaagtcagtcaaagcctgcgcggcctcggccggctcctgggtgggggcagtacgcaaggagatgcggaagcgggccgtgtccgcgatcacattgaaggagccatcaaccggatgggcgtcgaatccgatgaccgaggccgagggcttggtccacaggcgggaggccagggaaccggtgccagccagctggtaggagtccacaatgccggcgtcggcgcgcacctgggactcgtccatgtcgcgctgcaatccgccgattggttggtcggccttgactcccggcaccgccaggtcgccctgctcgtcgtacatggaggcgatcagcatggccgccagcgtattggcgtccaggacaggcccgccgaactgaccggagtggaccgggtgctccaaaaccttgagcgagacgtccaagtccaggtttccgcgcagggaggtggtcagactgggcaggtcgggggcccagttgccggaatcggccacgatgatcacatcggactcgaattcgccgcggtgggcttcgatgaaggggatgaaggagggcgagcccatctcttcctcgccttcgatgaagaccttgatgttgactttcaaatcctcgcccaaagctttgagagcgccggagtggatggcgatgccgccgccgtcgtcagccgcgccccgtccgtagagccggtcgccccgctcgctggcggtgaaggggtcggtcagccactggccgttgtcaggggccggctgcacatcgtggtgggcgtagagcaggacggtgggggcttccgggtccaccatcttggaaccgaccacttcgaaggcgccaggggtgccgtcggcgttgctggcctgcaccacgtgggcatccacgcccagctggctgagctcctgggcaacgaactgggccgatcgcttcatgtgctcgccggtgatgccctcggccgagaccgagcgcagggccactttttggctgagcagctccacaatcctggtccaatcaacctcgacccgatcccggagatcctgcgcgcttagggttgccatgaccgcctcctgcaaataagtgccgggcaagcccctggcgcccacccgcgtctagacttcaccgtaacctgttcgcatgacatggaagctattcaagggccgtgattccgacgattccacagaagagtcaagcccctcagaccaggacggcgcgaatcagaccgaaggcaaaggcaagcccactcctaagcgtcggcaggccgaacagcgcaacttgcgccccttggtccccaaagaccgcaaggccagccgaaaagccgaaaaagcgcggctgcgggccagggaggacgccgaatacgaggccatgcgcaccggcgatgtcgcccacatgcccaaggccgagcgcctgccctggcgcatctacatccgcgactatgtggacgcccgcttcggcgtcgccgagttcatgatgcctgccatcatcttcttcttcataatcacgatggtcgcgctgatggcctggcctcagctctacacagcctccatgatcgtcatgtacgcctacatcatcgcagtcatcctcgatttgttcgtcatgtggcgcaagctcaagaggcggctgattgacaagttcggcgagcgcgccgtggccaaaggctctcgctccgcctcctacgcttgcatgcgcgcctggcagttccgacgctggcgggtccccaagccccgctaccccacgcgcggccactggcctgagtgaccccaacccgctggccctggcctcaagccccgtcgcaagcccggagcgcaaccctggaccagtccgtggaggacggcctatgatgaacgcatggacgcacaagcggagcacaagcagtcagccactggcgatcaggacggcgaggacgccttcgacctggtcatcctagggtccgggcccggcggctatgccacagccctgcggtcagcccagttgggcgcaagcgtggccttggtcgagcgggacccggtggtcggcggcacctgcctgaaccgagggtgcatccccaccaaggccctggtcaccgccaccgatgccatcgccgaagctgcgcacgccagacagataggcgtccatgtggagtatcggggcatcgactacccccagctcaacgccttcaaacaaggcagcgtggatgccatgaccggtgggctgagccagctcctgaaccaacgaggcgtgagcgtcatccatggttcaggcgccctgatcgcccccgacgcggtcgaggtcagctgccaggacgggcccaaacgtcgcttgagcgcgcgaaacgtcgtcatcgccaccggctcgcgtcccacccccctggctggaatccccttctccggcgacgttttggattcggaccgggctctggccctggagcgtttccctgaacgcccagtcatcatcggtgccggcgccgtggccgtggaattcgcctccatatggcaggccgcaggcgcccagacgaccctgattattcgccgggaccgggtcctgtcaggctgggagcgccgcatcggctccacgctgacccgagaactcaaacgccagggcatccgggtcgtcacaggctcccaatgcgcctccatcaacccggatccccaaggcggcttagccatcagctccaagccttcggacgccgctgccgggcagggcgagtcggagatcatcaaggccgacaaggccctcctggccatagggcgcagcccgaacacggacgccccctggttcgccgaacagggcatcgaactgaccgagcgcggcttggtcgccacagatccctggggacgcaccacggttcccggcgtctgggccttgggggacatcacccccggcctgcacttcgcccaccgggccttcgagcagggcatcgtcatcgccgaagccatcgcagggctggaccctgaaccggtggacgaggccacaattcctcaggtggtcttctcccacccccaggccgcctgcgtgggctacacccgtcaacaggcgaaggacagcggtcgtttcacggacgtaagggagaccccctaccctatgctggccaacgctcggatgcatatgagcggccaagccggcgcgctctccctgatcaccgcccgacccatggacgccgccgaccaggggattcaggccgagccggtcgtcgtcggggtccatatggtctcccccatagccacggagctgatcgccgaggccgagcagctggtgggcgcccggacgcctgtcagccaggccgcccggctggtccacccccaccccaccttcagcgagactctgggcgaagccatgctcaaggccgatggacggcccctgcacatgcggtagactagtctcctgaatgaaaccctgacgatatgacgaggatggcatggcgcgagacacgaagaagaaggacaaaaaaaagaagaccggcacggttgcccagattcggcagattttcgctttcacctacaacgacgataaagcgctgccctggtatttagccgccgctttcctcctacccgtgctggtcgccctcgtcggctgtctgattttcaaggttggctggctctcgtggaccttgaccatgctcctgggcgtcatgctgggcgttctgctggccacaatcacgctgacccgccgctcggaccgcgtagggtaccggcaaatggatgggcgtcccggcgctgccggagccatcctggccaacatctccaaggccggtttctccttctcccaggaccccatttggatcgaccccaagaccaaggacgcgatttggcggggctgcggccgcaccggcgtctacctggtgggcgagggcgactacggccgggtcatgagggccatgggccgtgaagaggacaaggtcaagcggatcacccaaggctcggccatcccgatttacaaggtatccgtcggccacggcgacaagcaagtgcccctggagaaattgcagaaggccatcctgcgcaaaaaggccaagctgaccgcggaggagctcaaccagctcaaagcccgactgaacaccttgcagttgcgccaatcctcgctgaacatgcccaaggggatggacccgaccaaggtccacgtctcgcgcagggccctgcgcggtaagtaaagccggccctccccatcttggccagcgtcagggccgcgtgcctggaaacatccccgtaacctcctgttcgcgtgtgcgcgtggaccgcgctcctagactgttggctattgcgtttcgctacgaaaggagcggtcagatgaccgagctgaagacgaaggaagattgtcaggcgctcatcgatcaggagggcgtggagtacgtttcaatctgcttcactgatttgataggcgtgctccagcacatcacggtgccggccagcgagttcatcgacaacgccttcaccgatggcatggctttcgatggctcttcgatcgcgggcttccaggccatcaacgaatcggacatgaagctggtgcccgaccctgagaccgcgtacatcgacccctttcgcaagcacaagaccatgaacgtggtcttttcgatcgtcgatccggtcaccgatgagccatactcgcgcgaccccaggcagaccgcctccaaggcggaggcctacctcaggtccaccggcatagcggacaccgcctccttcgcccccgaagccgagttcttccttttcgacaaggtgcgctacgagaactccatgcgccgctccttctacgaggtggactccatcgaggccccctggaactccggtctggacaccgaggctgacggctcggccaacatcggcttcaagaacaaggtcaagggtggctacttccccctgccacccaccgaccactaccaggacctgcgagacgacatggtcgccaacctccagcaagtggggctgatcctggagcgttcccaccacgaggtgggcggcgccggccagcaggagatcaactaccgatacaacacgctgacccgcgcggccgacgacctgatgaagtacaaatacgtggttcacgagacggcggccatgaacggcaaagccgccactttcatgcccaagccgatagccggtgacaatggcaccggcatgcactgccaccagtccctctggcgttccggctcccccctcttctacgacgagaagggctacggcggcctgtccgacatcgcccgttggtacgtgggagggcttatcgcccactcctcctcggtgctggccttcacgaaccccaccttgaactcttacaagcgcctggtgccaggctacgaggccccggtcaacctcgtctattccgcccggaaccgttcggcggccatcaggatcccactggccggcacctcgccagcggccaagcgcattgaattccgcgcccccgacccctcatgcaacccctacctggccttctccgcccagctgatggctggtatcgacggcatcctgaaccataccgagcctccggagccgattgacaaggacctgtatgaactgcctccagaggagcacgaccgaatcaagcaggtgcctgcttccttggacgaagccctggacgccttggaggaggaccacgacttcctgaccgagggtgacgtgttcaccgaggacctgattgagacatggttggatttgaagcgcggcgagatcgaccggtcgcgtctggcccccaccccactggagtatgagctctatttccacatttaaaacagattcgcggtaagtcaacccccagtccggcgatcgggggtttcttgtagtctcgaaagtaagggaggatgacgcgcatgcgctggctgagggaattcatgagtctgccggtctacctgcgctccatgctcatcgtcgacctggtctgcagcatcggttcgggcctggtttgggccatcgaactgctgttcgccacccattccctgggtgcgagcatgagccaagctccgctgaccgtgacttgcagcgccatcggcgccctaatcgccaaccccatcgtcggctggctgtccgataagcgctcggcctggaccgccatgtacctgaccatggccctggccatcaccggttcgatcgccttctgcctctcacaaaccttcgctttcgcactgatcgcctccttcatctcaggcctaggcgtcagccaggcgacggcctggacgagcattctgacccacatctccagcgaggccgaccactcaatcgtctacggcatcaaccaggcggagatgaacctgggtgtaggtctgggcgcggccctgggcgggctgatagccgccaacggctcggacatgctttacaggctgagcttcgccggccgagccctcggtttcgcgttcatggtggtggcgctggtcattttggaacaccgctaccagctgcgcgccttgaccgccagcaggatggtgcggtcggagcaagtgacgctgcccaactcatccgtcccgtccagcgggtccaagtccccagcccccggaacgggccccttgccccagctcctgctgacgatggggatgctgaccatggcagccctgttcatgaatattttcggctactcccagatcgacgctggactggtcaccacaatcatttcggattcccaaataccggcttggtccctggctttggtggatgttgtcaacacttcggccgtggtgattttcaacgtaatcctcctgccccggctcaagagcaagaaccacgtcgccctcctgcgcgcggtcccactgtgctgggctggggcctggctcctggtcgacttcggactgagccggaacaccgcagcctccgccttgctcatcgcctgcctgggtgtctcggtcttcggcatgggtgaggtcctgctaggcatctcccagcccgtggtggcggccaagctgggtggcccgcgcttcagcggccgtctgttcggcatcctcaacaccgcccaggcggtcggttacatcgtaggtcccgccctcgcctcattgatcctgcgcttccacgcccccttgcccttgctcaccatctgcgcgatcgccctgctgattttctccatgccctggctcatggccctgcgcgtatctgccgatccccccgtccaggacggcgcgccaaccatgtaaagcccattccagcgcttatgccgcaccttcccaccgcctgcatgctcacctgcgatagggaagatccgcacggcctggttcagcgcttgcgctccagcctatcctcatgctgtcgccagtatgggtccgcataggcggccaccgcctgggagtgggtcacgaccagcacgcacttgcttcgttggtgggcaagcccggccgggatacccatgatggtccgttcggattccttgtccaggttccccgtgggctcgtcggcaatgatcacgtccgggcagagggccagggtccaggcgatttccacccgctgctgctcaccgcccgacatccgcaggaccttgcgtttggtagtggtctcgtcgatacccagcttggccaacagggctagggcatcgcccttttgtcggcgctcttgaccccggaaatctgcatggagagcacgatgttgtccagggcgcggcggtgtccaggccgtaaaccagcgagagcagtgtggtcttgcccgcgccggagcgacccatgatcgggaccagctcgtcttcgtcaaaggaggcggccacgcctttaagcacctggttgttgtacttgccatagtgatatgacagtttatccaatgctaaaacgctcatgctgctccctctagtttccttccgtaagaatgcttctgggctccaggcgggtggtggccgccacgctcaccagactggttatcaggacgatgcccagcgaaacgcccacgctctgccaggcggaccagctgtccaggccggtcctgatcttggctgaatcgacttgaaccggaccctcggcgtgggcatccatgacgaccgtgcccgccctcgcccggctgcttgactttcgctttctcgtcggcctcatatgacgcctgctggctggagagcatggactgcgcgcccggctgggtggccgccgccccgattcccagggccgcgtccttgggaggtcagtatctcgttctttcggttgctgaatgcatctttaaatggcatggattgatcgctcgtggtgccgtcggcgtagatgccggagactcgcaggctggacttgccgaagttcgccacttgctaggggctgggcggccctcctgtctgctgcttgcccggacccatcgtgtcgaagtcctgcgagagcgtcaccttggcccgtactggctgcggtagcctgctatcagatcggcccgaggccccgcggatcatcgctcccgtcgtcagatcacgatgatggccaggggtatgagggcgtagagcaggttcctgcccttattgcgccagatgtttttgagcgcgttggcaaagatgtacaatttgcgtcccttcgttcgtgtcgccgctcgggatcgcgacttacctaccggattcacactattgaggaggaaccgggaatcgtcccgacattagccggaagcccgctggggcttatctgggactttgttgggagcgaaatagactccagatgggccgggtccacgcccagggcggacgcccgaaggcagccgacagggctgaatccatggtcagcggagcatataggcggattgtatgaagtcttgataggacatggctgacaccgggccgccggaatggttgatcaacctagcatggctgacgtcctcaccgggatagcccgctcccacaccggcagggaagagtgtgtaggccatcgcgtggttgtgattaggctccaactcaatctccagggcgccggcgacttgaccggacgctccaggcgcgccaagttgcacggaggtgacatgaccggcgaaatcgggcgcgctgaccgagcagttgggggccagcgtggccgtctgccctagggaattcgtgtatgcaccttggtattggacgcactcaccgcctggattaggctgggcgagcgggtcgggctgcccggccgacgaggggccgccactagtggcagcgggggcggctgactccttggccttggctgcggcggattcgctggcttgcgcggaggctttgcgtttggccgccgcccgtgagctggacgccgacgcggaagcggacgccgaagcctcgcgctcggcttgtgcccgggcgttggcgtgggaaaccgaaatcccccaagctccaagcaggaccaccagcgccaggatcactgccgccacggctacgatgatgaccttcctccgatgtccatcagccccagccttccccccgtgccgttcgctcattcgtccgtccctttcgcctttgatcagactgtttcaggcccagtttacagcacaacgcgtctcgtccatcattgaaagccaatggccgtgccgcacccgtcgatgtctcgtcccggggaaccgaaccgacccaccctggcagcatccacctcaggcgattaatcggtgggccagggccttgaaagcggttgccataggagttggggccagcttcccgtcctcgccaagcacgaccggacggccggactcccccgcctctcgcaaatcggtctccagggggagctgagcgagaagggggacctcatagcccaggtcgccagtcaaccggtcggccacccgccggccacccccctgaccgaagatgcgcagacgctccccctcgtgctcgtaccaggccatgttctccaccacaccccgcacccggatcggcacttgcaaggccaccaggcccgagcgcaccgcgacgtcggaggcggacggttgcggggtggtaaccaccaccagctcggcgttgggcagggcctgggccacggaaatggccatgtcgccggtaccgggggccagatccaggatcagcacatcgggctcaccccaccacacgtcggtcaggaactgttccagggagcgctgaagccggggccctctccagaggatggcccgctcggacccggcgaacatgccgatcgagatgagtttgaccccccaggcggtgaccggcatcagcataccgttcaggttggtgggctgggagtgcacgccaaagaggcctggcagggagaatccgtaaatgtccgcgtcgatggccgccgtgtcgtagcccaaggcggcgaatgtggcggccagattggctgagaccgacgacttgcctactccccccttgcccgatgcgatggcgaagatccgggtcttggagcccgctttggtgaaggggttggaccgtcgctcggccttgagctggtcgaccagggattgaagcttgtccgcgctcatcgaggagacctcttggtgggggcgcaggatggctttggtgtaggaggagaccgcggcgtcgatccggtccgcgatggcccgggtcagggggcagccctcgatcgtcagctccacatagatggtgacgtcgaagaccggcaggtcaggaccgccaatctgagcggggccctcggtcgcgggttcgaccaggatgtcggtgatcatacccaggtcggtgattgggcggcccagctccgggtcgatgaccttgctgagacgagcgaagacatcgcttttgatgcggcgggcgaaggcctctaggtctgattggacgagcatggtcctccttcgtgcgtccagcagtcggctcgacttgcgctggatgagcggatgacgctccaagcgcgcgaagcgctcacggcacccaccctatagcggtcgccatgagcgcgccaggccttggcgcgaactgttaccggatgcgttttcaatcttgggtctgatccgcgcccgggtcggggctgccggtctccaggagcctgcggaagccgtcctcgtccagcatcgccactcccagggcctcggccttagcggctttggagccagggtcggcgccgacgaccacatacgtggtcttcttgctgaccgaggtcgtggccttccccccacgctcgatgatggcctccttagccgaatccctagtgaagcctttcagactgccggtcacgacgatggtcatcccggccagaacctgcggctggtcgattcgctcggtatggcagcccacaccggcagcggtccaggccttgaggatcttgccccgccagtcgccctcgcgtctggcgccagtgaaccaagagaagaccgaatgcgcgatttcgggacccaccccgtccaactccgccagatccttctcatcggccttactcagtgcgtccagactggtgtaacggcgggcgatgacccgggccgaagtggggcccaagtgacggatagacaaggccaccagcaccctccacaggtccacagagcgcgctttatcaatctctttgagcatcagcagggtgttgcgggcgggctgcccctgcccctcatcccccgcgaagcctgcctcctgttcgccaggaacactgttcatggccgcgccttcggcctgctcgggatggtcagcgaccccggacacggcggaatcaccaggggctccagcgttgcccgctgcgggcttgggaaggttgtagaaggcaggaaccctgtaccacaggcccgaatcaccgattttacggcgaacagtgcgccagtggtcgccctccacccggcgctcctcgatgatcggcacctgccgccagaccgcaatgtccttcaaatcctcgaccttgagcgagaataacccggcctcggacttgagcaccggctcctggacgggcggcagccgcacgcctgccggcggtatgtaaggttcaggctcctcgccagggcggacgacctgggcccgcaggtcaggcgcgtagacatcaaccgaatccggccggttctcctccgggttcgtcaacgcggtggccgattgctcccccaggtgctctatgtcgaaggccttgcgggaggccatgtggatgattcgctcggtcagctgggccgggcaggattccacgttcgggcagcggatgtccttgtcgttctccctcgccggggccagcttggctccgcaggaagggcagcgctcgggcatgacgaactcgcgcagggtgtcctcgcggccttggcgcttgtccagcactggcccgaccagctcgggaatcacatcgccggccttgcgaaccacgaccgtgtcgccgatcaacacccccttgtgcttgacctcggaagggttgtgcagggtggtgcgcgaaaccgtggaaccggctacgtaaaccggcttcagaatcgccaccggcgtgatgcgaccagtgcggcccacctgcacggtgatgtccaagagctcggtgtcgacttcctcggggggatacttgtatgcgatggcccagcgcggcgcgcgcgatgtggcgcctaggcggcgttgcaggtccctgtcctccagcttgacgacgatgccatccaaggcatgctcgatatcaccccggtgcttaccgtaatagtcgatcatcgacaggatttgatcgaaggaatccacctggcggttgtggggggagacggggatgccccacttcttataaagatcgtaggcctgggtctgatcgaccacctcatcgtgggtgccttcgggatgctcagccccccaggtcagtcggccgatcccgtgggcgtagaagctcaacttgcgctgggccgtgacgtgcgggtccttttggcgcagggagcctgcggccgcgttcctggggttggcgaaggggggtttgccctgggcctcttgggcgcggttgaggtcatcgaaatcctcgaagcgcatgaagacttcgccgcgcacctccacgaaatcgggaatatcagcccgatcgccgcccagattctgggggatcgaaccaatcgtacgcacattgagcgtgatgtcctcgcctgtgacgccgtcacctcgggtcaagccctgaatcagcacgccgttgcggtaaatcaggttcagggccagaccgtcgatcttcacttcggcgctcatcggcagccgcttgccttcaggccaatccagttccttgcgcaccccccggtaccattcgcgcagctcatcgattgagaagacatcgtccaggctcagcatctgactgggatggcgcacggaggtgaagtcgttggagaaggaaccgccgactcggtgcgtgggcgaaaggggcgtgtccagggaggggaactcactctccagggcttgcaagcatcgcatgcgagcgtcgtaggccgcgtcggatgagaccggtgaatcgttgacgtagtaggcgacctggtccgcctccacccaggaggccaagcgggcccagagccgttgggcctgggctgctgtcagactggagaggttcaactggcccagcttcatcgcatccgcatcatccgcttgcaaagcggaaatccactcatcggatcccagcatcgcctggcccgtcctcgtcatcgtcaactttcctccttaggagctcacgcattcagtgattgcaggaactgcacctctaccatatccaagccgtcgctgggctcgtcattcatgcgcgccgcggccatggacagggtgcgcgccggcacgaacagaccggcgtccacgcacacgcgtgccgcctggcgcactatcggctcaaccttggtgtggggccagaccgggattccttgctcagccaggaccctgcgcgcgtcctcgtaatccctgggaactgggatgcactgggaatcggcccgcgcggtcagctcttccaactcaccttggagggcggagacccggcctgggctgatgtgctcgctcatgatgtaggcggccgcggccaggtcgaattcgtcgcgcatccaagcggcgtaggcgagccggtagtatgcgaaggccgcatcggaacggtccaaagccacctgcagggcgttcaaggtggcggcccgggcgccggcccagtcctcctcacgggccagttgcacagccagtttcaggtggggcagggggtaggcgggagcgtaggaaaccatggcgttcaggtgtttcaaggcctgcggcccctgcttgagctggaccaggatgtcggccagctccaggtgggcgtagaagaggttgtcgggaatcagcagggtgtgctcgcccggcgtcgcgaacaggcggttgtagaccacacgctccgcgtaggagttgaagtagcagggcacggcttgcgggtcctggctgacggcgaaccgctcgtccagaccgctcacaacgttctcctccaatttcaaggcggcggccgggtcgccggaaaagagtaagtcacgggccttgacccgctcctggtccaagcgctcggacaggtcgaaggagaggtcgggcacctccctcccatcaatcagggaggaggtgacttggtcggccaggtcagccaactccgggtcgccaatcgtcttgaccgtttccatagcctgctgggccttggccgccgggccttcgccatgcttggcttccagccggcggaagtcggccatggcgcgttccaagaggtcggcccgctggattgaaagcccttcagcgccgctggcgcccaggatggcggcggccgctccgtcgaaggggaagtcctccagctcaggctcgtcctgggagccgcgtggggcgaagcgttcatcgcgcatgtcgaagacggcttcgaccggttccagaccgcctgtgccatcgaccgccatggccgcgtcgaacaggcggtagaaggccttggggtccttcagcccgtactggcgcagacgggccaggaaaacctcgcgggtgaaggtgacggtcaccaggttgcgcacggttgggttgctcttcgctgcggacagggggtcgctcccgccttgcccctcaggcgcgtccgagtcgccctcctcgctttgacccccgcccggctgaccgacgatgtccggcccggcgaaagccatggagtccaagtccaacccttgcatcaggtcggcgaactgggagttgaggtcctgttcagactcctcctggccgggcttaacgccctgggcggactcgccgccaggctcttggcccatggaatcacgcaccccttcgcccggctcttggccctgggccgcggagaccgcaggctgctcgtgagcgattatatggttggggtcgccgtgcacatccccatccttggggtcggccttggagccggtcgccggcaggccgcctgtccgagcctgttcgaaagccgccaaggcctggctcatcatctccgcaatcgctgtgtcttgctgagcctgcgcttcctccaaccccagggaatcgatatggagccagacctggcccaccccgtcgtcggcgccgaaggccagagccgccatcatcagcccaacgcgcaagttgtagtcggcgctcatcgcggcccgctcaccctcttccaagtccacccaacccctgtgggccgcgtcgaagcgggaggagggcatcatggtccggccggcgctggtgaaagcaatcgccacctggccgcgcttgaggtttgagcggaactccacgtcgaagcggaaaggcaaccttagactgcgcagcaggcgggagaaggtctgccggtagacccactcggatccaccggcgcccttggcgcgaccaggcctatggttcggcgggccggccgggtcgggctgcctggcggccagctctgaggcctgccgtcgcgccgcggagaacaagcccatgacgggctgccgtccgtcatcgctgaccgggtcgaaatcacggggcagatcctcttccatttgcagggcgctgatggctggatcctccaagagcgcctgatccagctgggcggcctgcacccgggtaaccgtgtcctcaaccgggtaaacgcccaaacgccagttgcgctccaaccaggccgagaccgcggcgaagcggttgaggttgccctctatacgcagcgccctgagcgcggcggaaagctccaagccgttctcccaggagaacatgtaggccccggaatacgaggacgcatacaagtgcatgggctcggcgccatgaaccgcctccaggcccgacacagggctcaaggcgcccgcctcccgcatcaaatcgccaaagtaatcctccagaccggaggtgcgcagcccttcggcccgcgcacggacggcgtcacccacgctgcggcggatggcccccataggcgcctcacggttgagcctgcggaagatgttgccagcgccgaagcccatgggcttaccgccgatcctcggcagcaggtaagcggagaagaaggaaatcgcaatcgcgtcgcggtattccaggtcatagcgcagatcagccggcaggtctgggcgcagctgctccaaggtgtaacggttgcccctcttgagccaggaggccagccaacgcatgcggtcggacccatcttggccgacgatgcccccctgcacggcctgcacgacctgcgcggacgaatccgtctccaacccgaagcgcggaccgagcgggagccgcacctggcgctccttgccgaacatgaaaaccggctccatgccgtgggtgtccatgtcttcccgctcaccggcgaagacccgtccccttccgtccgccaaggccacctgcgcgaaatggttccgatcggtgaacagacccaggcggaagccggagccgtggactgcaggctcctgcacccagcccaattcgaggccttcagggaccccatccatgtggggcaagatccgcctcttggccaaggggctgatgggacgggaccggtggcccaggaagtcacgcacctgctgggggcttaccccccggcctgattcagcggccgccttggccgcatcctgaagcgcctcacgcaagggctgggcggacccgccatcttcgtggcgcccgaggagagccccagccgctccccgcagccgccgcgtcatcctgcgcccaaaatccgccatgccgcctggtattgccttgctcgtgaccatgtcgtccattctccccgccaatccagacatgccgcttatagaataaaggggtgcatacacccctaccccgcccactggtggccttggcaaagagcaaaagcgtctgggccgctctggccttgatcgtcctgctggaatgctgcctgttcaacatgccccactggcgctccctggccactggcggggcgtcagcggaccaggggccagccccggcgtgcctgggcccaggcctggtcaggcttcccggcggagccttgaaagtctccgatcccacccaagcctggattgagacttcgtccaagacccaaccattggagtatctccaagtcctgcaaggcggggcgggcgccaacgggtccgagcgcatgctggagcgggtgcatgtccgcctggacctgcgagcgcctggcggccaagcctggacgccagccggcaccgccacattgagctcctccccctcctccgattacttgaggaaccgcagcaacgtcgcccaaccggcccaggcccgcttgtggatatcagaagctcgcgggtccctggtcgccgtgtccgggctgatcgtcaacccacgcgtccccttcgccttgcgccctgcccgcatagggctgatggccttggtggcggccctggtcatcgccttcctccccaactcccgtctctggcgaatccacctggacaccggctcgcgcctccagcgcctggccttttggctcgccatggcaccggtgggactgtgggcgtcctggaccgttgtgatccaaattgggggcttcgtgcccggcgacttccacgagcccggctcctacacctacgacttcaaccagtacggccatctggccgacaccatacttgccggacgcccctggctggacctgcccgttgcccagggtctggcccaggcgcccaacccctacagcgtggccgtgcgcgagcgcctgctcgcctctggccaaggtccgatctattgggattacgccttttaccagggacactggtattcctacttcggccccctgcccgccctcctgctcttcgccccctaccgggccctgaccagcctgttcgtgcccggcggactcatgctgcccacccctgccgcagccgcaatcctagtagccgggttcacgctgaccgggtccctcctgctggtgcgtctgatccgccgctatgtgcctggagccagcctgggcgcatgcgcctttgccctgctgactttcctgaccggttcccaattgacctacctgctgtaccgggatgacttctacgcaatccccttcgacgcgtccattctgctgtccacgcttggcctgtggctctggctgggagccaggcgggtgcggcccgtcagcggtggccgcacccgcccttggcgggccgaggacaacctggaggggtgcctggccctaacggcccaggaggtccgcctgagcctgccgcgcctggcggcgggatccttggccattggcgccaccctgggctgccgacagactttcatcgcctgggggcttctggctctgcccatattcgcgcccgagatcaaggctatgtcgaagggcctgcggcggaccaacccactctccgcctcccagcgcacggacgacccgctgaccatcgaaccggctttttcggccgccatcctgcccgccgccctcctgcccgtggtcctggtcgctctgcccttgctggcctataacgcctggcgtttcggctcccctttggatttcggcaaccgccaccaaatcaccgtcgtggatttgaaccgttatcgcccgcccctcagcaacctaccctggttggtcttctactacctcttccaacccctgaccggctcccaggccttcccctacgtccagcgcttccccgcccccctaccggtctggcagtacgcggagcccggcctcggcggcctgttcgccctgaccccaatcctggccctggcactggccctgcttgccttccggcgtgtgcgcgaaccactggaggagacctttgccgtccccctgctggaggtcctgctgggcctgtccgcggcgctcctggctttcaccgcctacatgggcggtttgaacccccgctacatgttggatttctcctgcctgttggcccttgccgccggcctgcccctagctcaagccctaggccacgatgcccgccggccaggccgcgaaaggcgagtcctgcgtctgatcgccttggcctgcctcctgttcggtctgctgacctgcgtcctctcctgcttgaccgccttggagggccagcccctgttcgaccaggtggcctcttggttcgcggccttctgaccagccagcgaaccagccccaccagccaatccgaacggcgaaccgatgactcagcccagcaaatcgtctacggcgctgatgatcgcctcgagcccggcacggaagtcctggggttcgggcaggagcgagagggccaagtatccgttagagggcatgtcgaaaaagtagccaggctgcccgctgtagccgtagccttcaatcagcctttcaaccagctccgtctcgtcgatcacggccgggaatcgcaggagcacgttccacccgccttcggccctgagcagggagatcgggcggccgtccagagcctggcccaggtagcgcagattgcctacgcaccgatcgcggacccgctcgctctgggccgacgcctgcgccaacaggcccggagcggcttgactgatcagttggctcatcggcaggtagtcgtcggctatcaggtccagacgcgcttttgcctgggccacttgctcagcgggaccggagacttgaatccaacccagcttggcctgaggggcggccagcatcttggagagcccatcaagggcgaaagtgagcgctccctcctcgcccgccaaccgcctgcggcccggcagcgggtccagctggtagtcgaagaagacctcgtcggcgatgatggccaagcctcggctgcgggccaggccaatcagcgcctcccgctcttgggggtgcaggtatgagccggtagggttgttggggttgatcagcacgatcgcgcgaatcctcgccccgtccggcccatccagggcggtgcgcaccccggccaaatcgatggtccaggagccatcgtagttcaactggtagggcaaggcctgcacgcactccagcctggctatcgactcgatcagggggtagccgggccgaggctccaggatcgcctcgcctgcgtcgcataggagtttcatcagccaggagtaagcctgggaggtggatgagagcaggtaaaggtcgtctgggtccaccggcgttccccgctgccccaggaaacgcgccagctccagccgcagctcgatagggcctcgtggctcggctcggtacacgccgggcaggctgtccaacgtgagcccatgccgggtagggttggagtcgttcaggggaatcggcgcctgccctcgcgcgaccgcctgggcctgggccagggctatgcggttaggctggctgggccccgtcctcccggagaatggcgcattcatatggcctcccacctttcgcggtcagaggccccgcgcccccgattccgttccaggttgcccctaccgggcgaccgtgggctggccggccttggccttgacctgctcgtcgatgtaggaggcgtaataagcggcgccgacgatgcccgcttggttgcgcaatttggcgggcacgattggggtgtctaccttgatgtagggcaggaatttctcgctgaccctgctgaccccgccgcctactacgaaacagtcagggctgaagtagcgctcaagcatctggtagtacttggtcaggcgggcagcccactttttgtaagagagcttcttcacatcgcgcaccgaagaggcggcgtagcgctcagcgtccttgccctccagggtcaggtggcccagctcggagttgggtatcaacacgccgtcgtatatcagcgccgagccgatgccggtgcccaaggtggtggcaatgaccagaccatcctggcccttcgccgcaccatagcgcacttccgccaggccggccgcatcagcgtcgttgaccaccgaaacaggtcggccgcatgcctcggagaagacctcccacacgtcctggcccagccaagcctggtccaggttggcgatgaagtcgattgggtgcccaggcctgacgggggcggggaaagcgacgcccaccggcgcgctctcaggaacctcgaactggtccaggagcttgcgcgccaccttaccgacggctttgggggtcgaatgctcaggggtcaggattttcttgcggggctcagcgaagtccccggcgactaggtccaccggggccgccttaatgccggatccaccgatgtcaatgccaaaagcctgggctgtctcaatcatccgctcgctccttcgccgtctgcgtatcgaaccggtacgatacgcattgtagcgcacccgctccccctagaccacccgcccggcgacgcgcctggtctgacgggcgagagaacatgaatgcatggccctagaacagacgagcacgaaccctgtcaccatctacttaacccgccacggggagaccaccgccaatgccatgcgcctgatgcaaggctggtcggacttccccctaaccaaccaaggcgtggaagggaccaagcagctgggacgaggactgagcggcatcagtttcagcgcggcctgggccggcatgctgacccgccagtggcgcacctgccgcaacgccctggactactccgacaacgccgaaatccaggtgggcatcgatcccgacctgcgcgaagccaacttcggctcttacgaaggcttcccatccgccgacctgatgcaggccatcttcggcccccgaggctacgcgcgcctggctgaagcccgtgccgaacttggctgggacgcggccgcccaactccaggaccgcatcgcgcaactggaccaggagaaccgtctcgacacgaacctggacccggccgaccgcgcggagaccagcgaccaggtggcccaacgcatggccgccgccttgaccaggatcggccgcgagcgcgagcaagctggcggaggcaacgtgctggtcgtctcctccggctcctcaatcgagattttcctcaccgccatcaagaacgacggcaagcccttcccgcccttcctcaacaactcggtcacccgtctggtctaccagcacggcgagttcacgattgacggcgaaatcgcctcgaccaagtatttcgagcgcggccagaactaggctgcccatcgtaagcgcatccgccagccggacgccctgcgcggccaagggccccgccagcgtcatcatctgcacgctggcggggcccttgccatccctgatgcattacttgagcggcggcataggtttccagtccggatcatgcaggagcttacgcgaatccagccagccacgcaccagctgcggcacgccgctgaacaggctcttgcggtccacggccaccagccggatcagctccttgacggcggtcgccgccgtgcccagggcgaacatggccggccggtagtccccatgggccataaagtaacgggccatgtaaccacggttgcgcatgatgtggtaacgattcatgtccgaggtggagttgagctgacgcaggccccccatgtcccagttggcgattggacgagtgcggcgcattacgacgtccgaaaccgcgaccggctgcgtgaccttgctcgccaggtagccgtacatcgtgtcatcccaatagatgaagaagcgcggatcgggcagcccgatctcctcgacgaccttgcgggagaagaaagcgccctcgaagcacatggtgttcatggccttccgcccggaggggccaaaggcggacggggccacagggtcgggtatgcccaaagaggttatgaaacggtactgccagtagaaggggccgccgtcgtagtccagccgtgcgccttgaatcacctggtagcgatcggtccacttggccaatagttccaggcccttgggctccacagccacgtcgtcgtccatcacccagaaccagttggcgcccagttcgtacgctttcttgacgccggccgagaacccgcccgcgccgccgccgttgcgttgttgaggaacatagaccactcgctcctgcttgccgtcggcatcgatgatggtcttgccccagcgtccggtcgcgcgagcggagaactgctcgaccatgatccgggtctccgctgagttctcgttgtccaccaccacaatccgccagggggcctgggtcagctgcaggatggagtcaaacaggttcgccagcaactcctggcgcttataggtgacgacgacgatggccgccttactcaaatcttgtgtcataaccacattgtggcaccgccccgcaacttttcaccccggccagcccaccccccaggctcggccggaccggccgcgccgatgacgacaagttcgagcagacgtcgcgctccggtccagcgtacgcgccccgggcctgaccacatcaccgaacccgatcgcgcccgcaacttcccaggtcttcaagacaggatggggccacccggtcatgctgcggcaccgccacacccggcgaacccccaagccagcaaggagtggagcgaggcgatgagccgttgactgcctagatcgctactgctatagtgacagctgttccaagtttcagggaaggtgaaattccttactggcggtagctgagtcacgtcactcaggagcccgcgacccgcgcaagcggtggatgtcggtgagaatccgaagccaacggtcacagtccggatggaagaaacgaggctctctatgagtgtatccaatcccaatcagcagcagccctccgatggcagggaccgtttacgcgacgcccactcgaccagtatcggcggatccggccgctggtccaccaagcgcatcgctatctacgccctgttcgtggccctgactatggtcctgagcttcttttccttccccatcttcccggccgcgccctggctcaagtacgatccctcgggcatcgtagtcctggtatgcggcttcgcattcgggccggccgccgcagccatcgtctcggtactgggcttcctcccccatctgttcaccaaccccttcggcgcaatcatctcgatggtggtggccctggccctgagcgtgcctgcggccctgatctaccggcggatgcgcagccgcgcaggcgccctggtcggaattgtgtgcggcgcggtgctggccgtccttgcggccatcgcctgcaatgtggtcatcacccccctttacgctcacatgtccatgaacgcggtgctggccatgatcgtgccgattctcctacccttcaacctgacgaagttcgccatccacggcgtcgtcaccttcctgatttacaagcccatctctgtcttggtcaacaagtagccacgcgtaaacgggcatgcggtcaagcatgacggtcatcaacgacgcgcgtttcctgcagggggcggacccagcgggcgacgaaccagcgggcgacgaaccagcgggcgaggacgctctcgcccgcctcaaagatgtgtctttctcatacgacggcggggccagttgggccctggacggcgtgacgctcgacgtccgaccaggcgagctcctgtgcatcctgggggcgaacgggtcaggcaaatccaccctggggcggatcctatccggggaggccgcaccggacctaggccaagtcgagctgatgggccgacaggtcttcgccaacggcaagggccgggagcgcttcctggacgcggacgcctaccgccaagcccgtaagcgcatcggcatggtctttcagaacccccaggatcaaatcgtcaccacggtggctgaggacgatgcggcgttcggcccggagaacctgggcatgccgcgccaggacatgctacggaccgtgcctgcagcactggaccaggtcggcatggaagcaagcgcgcgcggagacccgacccgcatgtccggcggtcagcagcagcgcctggccgtggccggaagcctggctatgggcccgaaaatgatggttttagacgagcctggggcaatgctcgatgcggacggtcggcgcgatatccaggcgattatgcgccgtctgaccgccagcggcacggccgtggtccatatcacccacctgttggaccaggctgagcaggccgatcgtctccttgtgcttgaccacggccagctagcggcagaaggcaaaccgcaagacgtgctcacacgcacggacctgtccgccatcaaccctgggagcaccgagcgcgcccgccgggacggcctagctggtccggcccacgacctcctgaccgagagctcagcctccctcgccgcctccgcgagcgcccaaggcactggtcaggcggctgcgttggcaatcgaactgtccgacgtatccttccgatttccccaagccagtaaggacagcttgaccagggtgaatctgcggctccaggcgggacgcgccctggccgtgataggccgtaacggatcaggcaagtccaccctggcccgcctgatttgcgccctggcgaagcccagccggggcagtgtccgggtggctggcctgcctctggccgggcccgacgcgcctcagggcaagcggcaacagcgcaggaacctgaaaaagctccggacgcgggtggggtatgtgatgcaatacccggagcgtcagctcttcgcggacacggtagcgcaggatgtggcctacggaccgggcaacatgggtttgagcgaagccgaagtgaaccagcgggtggatgacgccttgaatctattaggcatctccaatctagccgaccgctccccctttgacctgtccggcggccaacagcgtctagtcgccatcgcaggagtcgtggcctgcacccctcaggtgctcgtgctggatgaagtgacagctggcctggacccccaggctgccagccgcatcatgaatctcctggagctcctgcgccaaaaaggggtcaccatcgtactgaacacgcactccgagcgggaggccatgaacctggccgacctggccctcctgctggaggagggccaggtcgtgtccttcggcgccacagccgacgttctcgaaaactaccacctgctcctggagaatgctccccatagcctgcagaaaaaggcaggtccgacaggcgaagagggactgggcgcacaatcacaaaacagtccagcggatgcggatgggctggtcaaagtcgcagaagggaccgcagccaaagcgagcgtcgggaatgcggcaggcgggggcgcttccaccagtccggtcccccctctggattccacgaatgccgggacccgctcagccagccaaacccggccctctttagtcgcccgcctggaccccagggccaagattgtgactttcctgctggccatgctgaccgcctttttcatcagcacgcctctccagctccttcttggcctatgcgcgacggccgccctgttcgcggccgcccgggccccaatgcgttcgattctgcgctcggtcagggccttcctggttttgatggtcttcctagccgtcctgaacctcttggtcacccgcagcgggcatgagctgggccgttggggaccgctcgtggtgaccataggtggaatctgggtggccgtgctctactcctgccgtttcaccttgatcgtcctcctgggggccctgctggtccagaccacgactcccacgcagatgacagacgctttcgcctcgctgttcaaaccgttgacccggttgggcttgcacaccgacgaaatcgcgatggtgctctccttggcccttcgattcattcccacgttggaccaggagatgcgatcgatcatcgaatcgcaggcggcccgaggcggttcaatcgaatccggcggtccctccatgcgcctacatgcgaccatggcgattaccatcccagtcttcgctggggcccttcgccacgccgacaacctgagccgggcccttgacgcccgttgctacgagggcgggcgtggacgcactcattaccgcctcctctccctgggcaagacggacatggccttcatagccctcatgctggcttacgtactcgccctgattgccctcgggttgttttaaagacagcggaagctggcagagggctgggtagagggaccgaggacaccactgccaagcacgcctgaaacagcctcgttggagggcgccaccagcaacggggagacacccccgcgacgagggcatgcccactcagctgcctcgcctgcgcatatcttgaacgagcctgagtacaggcagagggtcgcgacgaattactcgtcgcgaccctctgcgtacgtctcaggatctcgctccccgcctaccggggactagtcactgagcgccgtcaccctgcgattctccggtctctgacggattccgtccagcctccagcctgtcaacttgagcctcgtcagccgctaggtcagcgtcaggcgtggctacggcagcccccaccagctccggctcgcgcccatccgaatcagccgcgtgcttgggcccgtcgaagggcttgcccttgaaagtgaactcgcccaggatgccctcgccctcagcgtccaccatgaccgactcgttgtcggtcaggtcgcccatcaggatcttctccgacatggcgtcctcgatgtcgcgttggatgacgcggcgcaaggggcgggcccccaagagtgggtcgaagcccttctcggcgagcaggtccttcgccttgtcggtcagctccagcgacatgtggcgctcgaagagccggtcgttgagcttcttgacttccaggtccacgatctggcgcacctggggctcggtcagctgctggaagacgatgatgtcgtccagacggttcaggaactcgggcctgaactgctgcttaagctcgctggtcacctgatccttcatgcgctggtaagacgtctccgtgttgttgcccaggttgaagccggtgttggccgccttggcgatgtcgcgggtgcccaggttagtggtcaggatgatgatcgtgttcttgaagtccacggtccttccctggccgtcggtcaagtgtccatcatccaatacctgcaagagggtgttgaagatgtcagggtgagccttctcgatctcgtcgaagagcaccacggagaagggcttgcgacgcaccttttcagtcagttcgccaccctcctcgtagcccacgtaccccggaggcgcgccgaagagacgcgaggacgcgtacttctccgagaactctgacatatccaccctgatcagggcgtcctcatcgtcaaagaggaactgggccaaggccttggccagctcggtcttgccgacgccggtcggcccggcgaagatgaaggagcctgcgggccgcttgggatctttgagtcccacgcgggtgcggcgaatcgaacgcgacagggcggagaccgcctcgtcctggccgatgatgcgcttgtggagttcggcctccatgcccaagagcttcttggactcggcctgggtaagcttgaagaccgggatgccggtggttgaggaaacgacctcggcgatcacatcctcgtccacgaccatcttgacgtcggactcgccctcgtgccaggccttctccttctccttgcgctcagcctccagcttctcctgcttgtctcgcagctcggcggccttctcgaagtcctggtccttgatggcctggtccttggagtcgttgaccttggagatcttggcgtccagctccttgagctcaggcggagcggtcagtcgcttgatgcgcaagcgggcgccagcctcatccaccaggtcgatggccttgtccggcaggttgcgatcctggatgtagcgggcggagagctcggcggcggactgaagggcgccatcggtgatggtcacatggtggtggtgctcgtagcgctcccgcagacccttcaggatctcgatggtctcggcgatcgtaggctcgggtacctggatgggctggaagcgccgctccagggccgcgtccttctcaatgtacttgcggtactcttcggtcgtggtcgcgccgatggtctgaagctcgccgcgggccagcaggggcttcagcatgtcggaagcgcccagggcgccgtccgccgaaccagcgccgacgatcgtgtgaatctcatcgatgaagaggatcacgtcgccacgggtcttgatttccttcaggaccttcttcaggcgctcctcgaagtcaccgcggtagcgcgaaccggccaccatggaacccagatccagcgagtagacctgcttatccttgagcgtctcgggcacatcgccctcatggatcttttgggccagcccctccacgacggcggtcttgcccacgccaggctcgccaatcaggaccgggttgttcttggtacggcgggagagcacgaccatgacgcgctcaatctccttggagcgaccaatcaccgggtccagcttgccttcggcggcctcttgtgtcaggttacggccaaattggtccaggatagcggacccggtctgcccacgcttgtcctggatgccaccggcgttcgccaggtcgcccttgtcggagccggagccttcgtggctgccgcggatcatgtcaatcgtggccgtgcgcaaatcgcccaggtccacacccatcttgatcagaacttgggtgcccacaccctcaccctcacggatgaggcccaggaggatatgctcggtgccgatgtaggagtggccgagttgcaaggcttcacgcagggagagctccagcacctgcttggcgtgcggggtgaacgggatgtgcccgttgggcgccgcgttgcccttgccgatcatctcctccacctgcttgcgggtggcttccagctcaactcccttggaggcgagcgccttggcggctacaccgtcgccttcgcgaatcaggcccaaaagcaggtgctcagtgccgatatagttgtgctgaagggcccgggcctcttcttgcgccagtacaatgacgcgccgcgcacggtcggtaaaccgctcaaacatacgtgtccttccctagaagactgctactcactctaccgatttgagatgacgaatattcacccggcgccgtctattgcgctcttaacgcaaaaaccctactgacgcttggtcctgcgccgcctgcgaacggtctccggctcgctgtgggggctctcttgggcgtcgtcttcggcttcttcgggcccctcgttgctgatttgctcgatcaactccacctcgggccgttcctcgcgcggagcctggcggaccacatcgatatggaggtcgtcaaaggccggagcggattgcacccagagcgggggcgcctgcggcgggtcgatctcggagtgctcgccgcagccgtggtccagggcgacgaccttgccgtcgtccgggctccaacggttggcgcagacgccgaacatggttcccagttcgccttgaatagggatcatgaaaccgcaggaagcgcaggtggcgcctttggcagtgcgcgtggacagtgatttgggcccccgctgtccttcgtaccagcgcttagcggtctgggccctgcccagggggctcaagacgtgccgcctcgtcagggcgaatcgctcgaccgccgaatccaggtcctgcttggaggcgcgcagccagtcccgttcagcctcatcctgttcgccctggtcgcttcgctcgtccgcttggtcgggctgatccccagccttcttgaaaatcgcgccaccggcgtcgaccagctcctgcgagccctgaacggtttgctcagcgtccttctgattcccctggctctcgctttcgtcttgcgcggcggactcgtagcccttgtcgcccggctggaggcccggttcaagcctagggtcgtccttctcggtgcccatcgcatcggtcaccgacaggtcggagggaagcaagcggtccttccaaggcacccaggccggcggaaggatggcgtctgaaccagggaccagggatgactcatcgaccgtccatcgatccagctcggcgtcgtggaagagggtgaccgaccacagccaaccctcatagcccttaatgagggaggcgaaacggaattcgctgaccccatcctccccctcgctggagccgatgaagtcaccaacctcgctgggatcggacgctactgacagggccacgtccctagccaggtcctgggggtcacgttgatcttggggcatcgccacaccttcgccatccgcctcgaccgccagagccaaggcacccgtcattatccatcgtctttgtcgtccgctgaccgcttgaccaaccgttcggaccgcccattcaggccgcccgcagtcagccgctagacctgcacgtcgaagtcgtccgccaccgcgcgcaacagggccgccagcttgcgcgactcctcgtccgccgggtagcggtgacggcgcaagtggccacccgccgaatcgagcagcttaatcaggtcctcaacgatcgcggccatgtcgtccggttgaggacgggtcgccttgaccaaagagggggcggacccgaccagctggacatccatggcctgaggtcctttgcggcctgcgaccacggagaagtccacccgggtgcccttgcgtagggtctgcactccagcgggcagggccgaggccggcaggaacacatcctccccctcgtctccggttatgaatccaaagccgcgcttggcatcgtaccaacgcactttcccgctgggcatgactactctccttcagttgcataggctcgtagcgggcgagcctgttgcgccccaccgccgtaataccaccagtctatctcagacagtatccctgatagagtaagcgccccactcgccaaagcgacgggcctcccgcccctacagatgcgttggccgccgcaacccgggggttacggcggccaacgtgaatagggactcagagcgtcaccgttccccgtcctcccgccgttcgtcatcctcactacgggctgccggggcgccccagcctttgactgcctcatacgccgtgtaggcggtcaccagcagcaggcacagggaaaagacggccgtggaccaggtaaggagagtaccgtcacgagacgcctcccataaggactggatcagccagaccgcacaggccacagcggtgaaaccgtatagcctggcccgcgatcgctcattaagtttcatgtgcgttcctttcctcatgcacctaatccattgccccgaccggccgggtctggaccggtgtcaccactccagacccgagcatcgacgctagcggcgccttcggggcgcggttcagctcttcttgcgcttagagatgatgtcgaccgctacggccagcaggagcaccaggcccttgatggttttcacaatggctgtgtccacacccataatcgacaggccctggttgatgacacccatcacgaaagcgccgaccacagcaccggggatggtgccgacgccgccagccacggccgtaccaccgatgaagcaggaggcgatggcatccatctcgaactccataccggactgggcggtggccgaagctaggcgggagagcatgcagatggcggccacagcggacaggaagcccatgtggacgaaaaggatgaagtcaacacgcttggtgttgatgccggagagaatggcggccttccggttgccacccacggcgtagacatgacggccgaagaccgtgcgggtcaggatgaagttgtagaccagcaccagcacgcccacgatgaccagcatgattgggatgccgccctgagtggcgttacctgaggaggccagcaggtaggtgacgaacaggatggccacggagattacggcgatcttgataatcgtcaggctcatgggctcgggaatcagaccaaccttctcggccctgcggcgcttggacagctggctccaggcgtaggccacgatgcacagcagaccgaccacgaccgtcagaccgtcgaactgcccccagaatccgaagatgttgggcaagtagttgcgggcgataccgcggaaagcatcggaggtgatcgggacagactcgccaacgatgacagtggccaggccacggaagatcaacatgccagccaaggtggtaatgaagccggggatacccacgtaggccacccagaagccctgccacatgccgatgatcacacccaccagcagcgacaccacgatggccagcatccagttgacgccctgccgttccatcaggatggcgcacacgccgccgatgaaggccactagcgatccaacggacaggtcgatgtgggtggcgatgatgaccatcaccataccgatggccaggatgatcacgtaagcgttctgctggatgagcgagacgaaactgttgggcttgagaagcacgcccttggtcagcacttcgaacaccaccacgatgaccagcaacgccgccacgatgccgtactgccgggcgttgttggcaatggtcgccaggaggccattgccctcctgcttctgcttggccgggctggccggacttgcggttgccgagctcatgatactgccacttccttttccttggtcatacccttcatcaggtattcctgggtaaatccattcttatccacgttgtcggtgattacgccttggctgacggtgtagatgcggtcgcatataccgatcagctcgggcagttcggacgagatgacgatgacggccttgccggcatcggccagctggtcgatgatctcgtagatctcatacttagcgcccacatcgatgcctcgggtgggttcgtcgaggatgaggatgtccgggtcggcgatcacccatttggacaacaccaccttctgctggttaccgcccgagagcgtgtccacgccctcgtcgatgtcgcggcacttgatgcggaactcgcgccggtacttctcgacttccttgacctcctcattgtcgtccatcacgccgttcttgctcatgcgcttgagggaggccatggaggcgttctcgcgaatgttctgcagcaggttgagcccgtagaccttgcggtcctcggtggcgtaggccagtccggcgtcgatggcggcctgcacattgggcagattcaccttcttgcccttgatgtagaccgagccggagatgcccgaaccataggagcgcccgaacacggacatggccagctcggtacggccggcgcccatcagaccggcgagaccgacgatctcgccggacctggcctctatgttggcgtggtcgaccaccactcggctggagtcgagcgggtggtggaccgtccaatcctcgatccggaaatactcgggaccgggcttgttggctggatggtcgggatacaggttggtcagaggcctgcccaccatcttgcggatgagctcgtcctggtccagcggcgtctccttggtcacgaacatggtccccacggtcgagccgtctcggatgatcgtgacgttgtcggctatctgggccacctcgttgagcttgtgggtgataatgatgcacgtcaccccgtgctcgtcgcgcagctggcgcaccaggctcagcaggtgggcggagtcctcgtcgttcagggcggcggtgggctcgtccaagatgagcaacttgacgttcttggacagggccttggcaatctcgaccagctgctgcttgccgacacccatgtccatgatcttggtgtccgggtcgtcgggaagccccacccgctccatcagccgcttggcctcggaacgcgtggcgttccagtcgattacgccgcccttggcctgctcgttgccgatgaaaatgttctcggccaccgacaggtaggggctcagggccagctcctggtggatgatgacgatgccatcggcctcggagtccttgatgttgcggtatttgcacgtcttgccgtcaaagctgatcgtgccggtgtaacttccatacggatacacaccagaaagcacattcatcagggtggacttgcccgcgccgttctcaccgcagatcgcgtggatctcgccacgctccacggagaggttcacctggcttaaggcggtgacctgaccgaatgtcttggtgatgccatccatatgcaaaatggtgtctgaatcagacatttcatcactccttgttggtctgaatacgcccggcggcggcacctgacgcgatgcgcgccgcggggccgggatggcggggcggcctccatcccagaccgccccgcctcagcggctattgggcagcgacgtcgcccgagaccagcttgtcgaatcgatcctgggtgagatacttcgccttaaccaggtcgggcaggttgtccttggtgatgttctgcgggtcgagcaactcggagggcacgtcgatggtgttgttgttgaacttaccgttcaggccggtgaccttcttgccctgcgcgatctccatcaccatgtcgtacacggcgttggccagcttgttcacgtccttgaacacggtctggccctgggtgcccttggcgatgttggccacagcgatctccatagcgtcctggccggtgatgtagggccagttggcgccgccaggctgcatgtcggggcgcttggactggatggcgttgatcacaccctgggagatgccgtcgtaggggctgagaaccgcatccagcttctcaccatgcgcgtagctggaatccaggatggattccatatccttctgggcctgctcggctttccacgactgcacggagatcttctgccaatccgaaagcttgaagtccttgtttacgccgccgccgtggttggaggggctcaccagcacgccggacttgaagtagggctgcaacagctgccaggcacccttgaagaagtacttggcgttgttgtcgtcgggcgagccagagaagagctccacattgaaggggcccttggcgccggtcttgagaccaagcttgtcgatcagatagttggcctccaacacaccggtctgctccagctggaaggtagcgtagtagtcgacggccttggtgttcatgatcaggcggtcgtaagcgatgaccttggcgccggcgtcgtgggccttttccacggccgggccgacagcggtgccatccttggaggccacgaccacgatcttggcgttgttgtttaccatattctcgatgtcggcgttctgctgggcgggcttatcgtcagcgaaggagaggatgaccttgtaaccggccgcctccagcttcttcttaaggttgttgccgtccttgttccaacgttcctcggacttggttggcatggagatgccaatggtggcgcccttctctatgcctccctgggccccgtccgcatactggcctccacgggtgtggctgcaagccgacaacgacaggcaggcggcgacacccacgaccaccgcgaacgctttcttggtcaagtgcatctttgtactctctttccccatcttgttcggacaagcacctgcgcttgccagccccccgatgagatggcgggcataaagataagagtatcgctttatgttaagttgtcaaactcaataacgcctataaactggttttgcattttaaaaccaaatacaataccgctgcccctttccccccgcgatatcctgtgcacctaggcaaccccaacaaccgcccgcgaaagcgctacacttgagtgtcatggcacgtgcattcggttctcaaagctccctacgggagggcaaccgtgccttgatccaggaggcgatcaccaggttcggcgccatgacgcaagtggaactggcagagaccactgggctgtccactgccactgtgtccaccttggtgcgccaactggtcgacgagcggcgcctggagacgcagaacaccatacggaacgggcgtagggccacgctggtagcgccagcccgcaaggacgggctactcgtaggcgtgcacatcggtgagcgcgaactcctgatcgacgtgattgactactccaagaccatcctggccagccaccggctccccctcgccttcagccacaaggccgataccaccatcgagcgagctatcatcctgatcaacgagactgtgcacagcatcggcgcctcacccaacgaaatcaagggcgtgggcctgaccgtcgccgccccggtcgactccatccggcacgtcatcgccgtccccggcatcctccccggctgggacggcatcgatctagccggtccgttcggaactgcgctgcaagtgccggtggtggtggacaacgacgcgaatgcgggcgccatctgcgagttcaggatgggcgccacggtcggcaaaggcaatttcatctacgttgacgcgagcagcggcgttggggccggaatcatggttaacggctccctcatgcgcggtgtgaccggattggccggggagatcgggcacatccaggtcgaccccctgggctcaatctgcgcctgcggcaaccgcggatgcctgaacaccgtcgttggcgaggaacggctgatctccctgctcagcgtgacccacggcaacatgaccttggaagacctggtcggctccgcactggccggcgaccccggctgccgcagggtcatatcggacgcggccgtgcgcatcggcacggtgaccgcggatctgtgcatatcggtggaccccgaactcgtcgtggtcggcggcaggctggccaccgccggcgacatgttcctggaccccctggccgaggcgctccagcgcttgctgttccctaacgctttgacccctatacaagtggtatcctctcaatatccactggatgcgccggcactgggggccgccctgctcgtcatggacagagaggacaggccaccagcatgagacgacggtggatggcgtgccaatgatgaggcggaacatgacacaaacagctaacacaccactcttggaactccgcgacatcaccatgcggtttgggttcatcgaagcactcaaatcagtggacttcaccatcttcccccaggaggtggtcgctgtggtcggcgacaatggcgccggtaagtccacactgatgaaggtcatcgccggcctgtaccaacccacgaaaggcgatatccgttggcggggcgggccggtaacaatcagcaatgtgcatgaagctgactccatgggcatcggcaccgtcttccaagggcaggagttctgcgagaacctcaacgtttcggacaacctctttctgggccgagaactcaccagaagggctggcatccgtgacgacgaggccatgcgctcacgctcacgcaggattctggacaccttcgcttcctcgattggcatcgggcagtccatcgcctccctctcgaccgggcagcgtcagacggtggccatagcccgcactttgctcaacaaccccagcctggtgctgctggacgaaccgacggcctccctatccgtcatgcaaaccgccgaggtgctcacctacatcaaacggctgcggaccgaggggcgctcggtcatgatgatctgccacgacctcccggacgtgttcgctgtggcggaccgcatcgtcgtgttgcgccagggccggatcaacggcgtgcacaacaccgaagacaccagctacgaagagatcatcgcccaaatcgctggcgtcgacaccgacggcgaggggcccggcgcccatccaaccaagcgcaagcggaccgaccatcaggggcgcatgctgatcgacaggagtatgcgcgtcaaagccgccatatcccggaccggggagggtggctgaccgaccagagagactgcgcgccgcccatccaccctcctaccaccgatcgtaaggaaaccgccatatgtccactttcgacctcaccatcatcatctgctccactatggccggcctggtcatcggtggcctgttcggggccttaccctggaagcaggagcagttgagcgaccgccagcagcgcatgcaacagatgaccgggttcatcgggctctgcggcgtgctggcactcatcctgacccgccaagacgccgcctcctgggctctcatcatcgccatgatcgccggcgtcggcctggtgcgcataccgcccttgtacgcgtggatcatcaagcgcttccccgtctgccgtcccaccagcaagaaacacaagtcacgcactactaagaagggcaaaaccggcaagcgctgagcaggggggcatttattccggtggcatccctcacaaagcgcccgccgcggtaacaagaccacggcgggcgcctcctactctctagtgaacggcggaatggccgtataagaaacccgccaaagcagcctctggatccactcagcgggcctaactcagtcagcgtccccctgtggcgtggcggcatccactcgcccctgcggcagcaccacagtgaaggtcaggccaccgccgggcgtggccgaagcgcagatgaggccttggtgggccttcacaatcgagcgcacaattgccagtcccagtccggtgccacctttaagtcgagccctggacgggtcggcggtgtagaagcgctcgaacaggcgaggtaaggcctcctgactagcgccgggcccgtgatcgctgaagcgcatgatcacgtaatcaccaccgttgtcggcaccagcaggaccggctgcctggatcagggcgtccaaggagtcttcgctgggcggcatgaaagtcaaccgccccgactcccagggcagcgaaatccggcccaagccgatttcgaccgggctgtccggtggggtgtagcggtggacgttgccgatgatgttggtcaccacctgccgcagacgggtggggtcgccgaccaagtcgatgcgctcccaaggagccttacggaagacgaatgcgttgccgccgccctttggaaggtccagcaaaccacgggtgatttcgcggtcggggtccaaggcgtgcaggtcatccaccgcgtcgttgaccaaggaggtcaggttgacgtccaggctggtatccactcccctgccttcatccatccgggccagggagaggaggtcctggacaagctcggtcatgcgggtggaagaggcctcgatatgcccaatcgactcgtcggcccgctccagggcgccaggcagctccctttgcatccggtagagctcggcgtagccatggatggcggccaagggggtacgcaactcatgactggcgtcggagacgaactgcttcatcttctccgtggtcgcctgttgctcacggaaactacgctcgatccgggccagcatggcgttgagggaggcggccagggacccgacttcggtgttgacaggaccagctgggatgcgcctggaaagatcgccggcggcaatcttggccgcggttttctccatgcgtttaagcggggccagcgtattctgaatcaggagggccgcgatcaccgcccccaacagcacgatcaggatgccgaccatccagcagtattgggtcagagcatggatcgtgtcttgttggtcgcccaacgacaggcctatgaacaagacccccttgctgacgcccatgccgcccgggtcgtccaggctccagcgcatggccaccacccgccagggggcgttggcgcgtttaaggccgtctcggtcgacgggcccgtcagtggatttgctgatcaccgccggcgtggtgaatggttgccccatctgcacgccaccatcctggccgtcggccggcagcttggggacggacaccacgccgttgacccgcatggggttcaggtcgtcggagatgatgaccatgttactgtcgcgcacttgcaggaagtagtcagtgggccccagcccatgcttgcttaagtcctcgcggttgagcagggtggcgttgcggatgcccagtttggcctgtcgaatcagctgggtgtcggtcttttgcaggagataggtgcccgccatctggcgaatggccagggaaatgccgagtgtgcccacaaccagcaggaccaacatggagacaatcagcttggtggtcaggggtatggaatccagcagcctctgacgggactggccctcctctgtgccctggccctccggcgcggcggtcgaggcgaccggagaggcgtgcaaggaatcgcggccttgagcgctcatcgctcgtccatagagcccttagggccgcgaatcatgtaaccaatgccgcgcttggtctgaatcagcggctcaaccttgctggatcggccgtccggaccggtaactgtgacgccatccacttttttgcgcaagtatgagatgtaggattcgacgatcgcggcgtcgccgccccagtcatactgccagacatggtcgagaatctgcgccttggacaacacacgtccctcattgtccatcaggtagcgcaaaagcttgtattcagtggggctcagttcaatcggctgaccagctcgggtcacgtcgtgcgagtcctcgttgatctccaggtcgcctacgcgcaggatcggactatcctcagcctgctcgtgggtgcgccgcaggatggcgcgaatcctggcgaccacctcctccagggagaagggtttcgtcacgtaatcgtcgccaccgactgtgagtcccatgattttgtcctgcgtgtcgtcgcgcgcggtgaggaagagaatcggggcggagacgccctcttgccggatgcgggaggtcacagtgaacccgtcgatgtcgggcagcatgacatccaacacaatcaggtccggctgcgtgcgctcgatcacttcgatggcttcggatcccgaggctgcggtcgtcacctcgaaaccggcgaaatgcagggaagcgacgagaaggtcccgaatggatggctcgtcgtccaccacaacgatggatgcttcaataggcttgctcataactctagcgtgccgcctgctcctgagcgtttcctgtatattcactgtgacgtcccaaccgcttcctttggcgacgccgacggaaccaccagatgaccgccgctgccaccaacaaggccaagaccaccccgccgacagcgacccaacgcagggtcgtccgccgctcatggtcactcttggagcgatcaacctggcgcatcaacgcctgggcggaacccacccagtccggcgtatccttgtcgctgatgggacccaaagccgcctgggagaggtcatcgacggtggactgctccttgagccaagcgtcggagttggcggagaccgccacgaccagtctgccgtccttcgaggccaccgccaaaaggaccgtgttcgctggtggcttggttgattccaagacctggctggcccacttgtccgggttgctgcccgggtagaaggagggcaggtaaaggaggcgaacatggacgccggtcttgctctgggtctcattaatagcgtcagtgaccgcgccgacgttcgatcccagaaggttctgggtatcggttatctggtcggtcagggcgccaacctcccccttctcgccggtggagccagcagccctagcggaagcagttgggacaaccagggacagcaaaaccatgaacacgaccagaaggcaggcgaaaaaggccgtgaagagctgattgcccctgacccggggcgaacgcttatccacatcgcccgcgcgagtcccacattcgaccacatgctcccgcaaaccgcatccaccgtcctcacacgtcatagggtccactgtagcggcagatatggaagggctggaggccgcccagcgtacgaacgaaagtcacaaaagaaaggaaggcttcatgcctcagtatcaagtggattcagaacagatccagtccgcgggttccgccgtctcctcctcgatcgcgtcaatcagggacgcagtcagcgggatgtactcgaacctggacaatctccaatcggtgtggaccggcgcagcggccagccagttcaacgcggtcgcggcccagtggcgcagcgcccaacagcagatggagcaggccttggagggcatgcaatccgctctgacccaggcctcctcggtctactcggacgccgaagcccaagcggcccggctcttcgcatcctcctgagaccctacggtttttcaccccccggtcgccggacgagcccggcagccgcagaagaccccggtcggattcgccggaccagcgccatcgcgttggcctcgcgaatccgaccggggtcgtgtacggggccgtctaggaacgaccccttaagccctatgcaggaagcttcaggctcagtagcccatgtcagggttggccggggcagccggagcggcaggctcaggcttgttggccacgacagcctcagtggtcaggaagaggccggcgatggaggccgcgttctgcagggcggaacgggtcaccttgaccgggtcggccacgccggcgtccagcatgttcacgtactcgttggtggcggcgttgaagccctcaccagtgggcagggtgcgaaccttgtcgatgacgacatcgccggacagaccgcagttttctgcgatttgcttaatcggggcctcgatggcgcggaagacgatagcggcgccagtggcctcatcgccctcgagcttgacagtggactccaccttggcggaagcctgaatcagggccacaccaccaccgggcagcaggccttcctcaacagccgccttggcgtttcgcacggcgtcctcgatgcgatgcttgcgctccttggcctccacctcggtggcggcgccgaccttgatgacggccacgccaccggccagcttggccagacgctcctggagcttctcacgatcgtaatcggagtcggtgttctcgatctcggcgcgaatctgggccacacgagcctggacttcttccttggagccgccgccggagacgatggtggtctcatccttggagacgatgaccttcttggcggtgccgagcacggaggtgtcgatggagtcgagcttcagacccagctcatcggacaccacctgggcgcccgtcaggatggccatatcctgcagcatggccttccggcgatccccgaagccaggggccttgaccgcgcaggagttgaaggtgccgcgaatcttgttcagaatcagggtgggcagcgcctcgccgtccacgtcctcggccacgatcagcagcggcttgccggtcttcatgaccagctcagcgatgtgaaccacgtcctgctggctggacaccttgcccgaggtgagcaggatgtaggggtcatcgagcacggcggtctggtcgtcgttgttggtcacgaagtagggggcgatgtagcccttgtcgaaacgcatgccctcggtgaactcgaggtccaggccgaagcggttgttgtcctcgacggtcacgacgccgtcctggccgaccttgtccagggcctcggcgatttcctggccgacctcggggtcagcggcggagatagtggccgtggcggcgatctgctccttggtctcgacatccttggactcggcgatcagttccttgacgatggcgtcagcggccttctcgataccgcgacgcagggcgatcgggttggacccggcggccacgttcttcaggccttcgtgcaccagggactgagcgaggacggtagcggtcgtggtgccgtcgccggccacgtcgtcggtcttcttagcgacttccttgaccagctcggcgccgatgcgctcgtagggatcttccaggtcgatttccttggcgatcgaaacgccgtcgttggtgatggtcggagcgccgtaggacttatccagcacgacgttgcggcccttggggcccagcgtgaccttgacggtgtcggccagcttgtccaggccggcgagcattccctggcgggcttcctcgtcatacgcgatgatctttgccatctgtaatcctccaacatggcttgagtgttcatgtccaccctgggcgggagcgaagggccagccgtcagctgccgacttatcactctcacgcttcgagtgctaagcacgagattagcactcgacgactccgagtgccaaccccgcccagtcgaatacgcttgcggcgagaaccgcggtcgcaccgcatcacctttgacctcaatgagcggcccaaacccggggcggcgcatctggatgggctttcgcgccaaagctgtcggaaatccgagaaaaacgtgcccgtccgccgctccgtccacccgagcccacggaaaagcacggcctcactccaggggttcgacgccgagcccgaaaacccgcacccaccgcaacggcatatccagagtccaggcgaagacacgaccgtgaccgagccggggtcgtccgcgggcacgaaaaaggccccggcaccagccggagcctgcagggaatcccaagtagggcccgttgctaaagaatcagatcacgcgagcggtcgtggcctgcagacccttcgcgctcctctcgacttcgtactcaaccttgtcgccctcatgaagaagcttgtgagagtccggcgagtcaatcgcagagtagtggacgaaaatgtcctcgctgccatcatcgggggtgatgaaaccatatcccttttgatcgctgaagaatttcacagttccttgtgccataactaacttccttaatataaatcgctgtgtcacagcagatacgaaactgaccgcagctgccaaatcagctctttcagtttatccgaccagtaggaagaaacgccgaagcgggaccgcgattttccactctcccaccgctcccggttcagttgcgcaggaccgcgacgataggggccgacgcgcttggaacttgctggacgctggcgatgcccagcgtcttcgccacgtcctcggcggtcgctttgtcgctctcgttctggtaccagacgacactggccgggggcagctgccctgtcgggttgtccgcggtgacgctcgtatagccggcggagaccaaggcctggcgtctgctagcggcgtaaccggtgattgaggttccgttgatcacccgcacctgagccgatttattggccacaggagccggcgctggctgctgagtctgactggccgcaggcgaaggctgggccgactgggagggagctgcttggctcggggacttgctttcgttgccttgctggccctgcgccccattgctcttcgcccgcccggcttcgactttacggcggacctggtcaaccttggcggagctggtctgctggtgctgccagggcatcttgccaccagagacgacggtccaagcgcccaagccgcacaagacggccaaaaggataatgacgatgacagggaccacccgaacggcgagcgagcgcgggccacggtggaccccgaccggcccctccggcgggtcatcgaactcgtccggcgtgtacggctggtaaccggcgttctcgtcgcgtttgcttgccatagaccgaccttcctccgtccgtccgccatgcaccaaggcgtgcatcctccggacacgtataaggcacagtctaatagtcagcccggtcagcagtccgaaaggcccacccggcaatcgctgattggacacattatagttacagcatatggagccgatggaacaagcggggctctttaacgagcccgaagacccgaagacgcaggaccagcaaaccactgaatcgacgacgggaggtggcccggcagccaatcgtaagcccctgtccgagctcatcgaaccaggctgggcgcgggcgctcgcccccgttgagcctcagattcaccggatgggggacttcctgcgctccgaactggcccaaggccaccgctacctgccggcctccaagaacatccttcgggccttcacgattcccttcgactcggtcaaggtcctgctcgtgggccaggacccctaccccacccccggccatccggtgggactgagcttctgcgtggagccgaatgtggacccagtgcccggaagcctgcgcaacatcttcaccgaactggtctccgacctcggcgtagcccgtcccaccaacggcgatttgaccccctggacccaccagggcgtcctcctgctcaaccgctgcctgacggtgcgcgtcggcaagcccgccagccaccgaggcaagggctgggaggaagtcaccgacgccgccatccgggccctgaacgcccgcaaggacccgcatggcaagcccaaacccctggtcgcgatcctgtggggcaggcaggcgcaaagcctcgagcccctgctgaccaacgcttacgtcatcaaatcgccccacccttcacccctgtcggcccgctatggctttttcggctccaagcctttctcacggaccaacgaagccctgcgctcgatgggggctgagcccgtggattggcggctgcgctaggaatcggcggggtccctttcgtcaagaaagaccgctagagtactgcctatggctttattccctcccagacaaaacaccggcactcccacgtcggccagtgccgccatgcctcgagcagcggcctcgcccactcctttgagccgggacgacttagcaagggccagcgcgttagccgaccaaatccgttcccgcttcgcttccaccctggtaggccaggacgacctgcgcgaagccttgttggtcacgatggccgcctccggccacatcctgattgaatcagtgccaggcctggccaaaaccacggccgcccagaccctggcctcctccgtctcgggctccttcaagcgggtgcagtgcacgcccgacctgatgccatccgacctggtaggcacacaggtcttcgacttctccaggcagaccttctccacccagctagggcccatccacgctaatttcgtgctcctggacgaaatcaaccgttccaacgccaagacccagtccgccatgctggaggctatggccgagggggccaccacgatcggcggccagcgctaccccctgccccagcccttcatggtcatcgccacccagaaccccatcgaggaggaaggcacctacaacctgcccgaagctcagatggaccggttcatgatgaaagcggtcatgacctatccgaacgccgatgaagagacgcggatgctgcacatgctgaccagccgaggcaccgacatgccccaggcggaccagcggaacatgctgtccctggatgacgtgctcttcctgcgccaggctgcccgccgggtgcatgtggccgagccgatcatgaggtacgcggtcgacatcgccgccaccagccgaggcgccgggagccggcccatccagggcctgtcttcccgcgtccgcctgggtgcaagcccccgagcctcaatcgccctggtcaggatcggacaagcccacgccctgataagcggccgcgactacgtcatacccgaggacctgaaggaattcgcccaccaagtcctgcgccaccgcatcctactgaccttcgaggccatggcggatggggtgaccagcgaacaagtgattgatacgattctggaaacggtgcccgccccatgattcggcccgcacccaaccaggaccccatccgccgcaagatcgaggccctgagcacccaattgagcctcccgaccgtgcgacgggccttgggaatcctggaaggtgagcatccttcgggcgagcgtggctccggctacgattacctgggcgtgcggccctacgagcccggggacgagtcccggctgattgattggcgctcctccgcccgcatgggccggcctatgatcaccgagcgcgagcgcctgaccaccagccgcgtgtggctcctgatggacgctggcgcgcaaatgggggcgaccaccccctccggagagagcgcggcgaccgtcgctgccaatgccttgaggatgttcgccgccctctccctgcgtcgatcggacgaggtctccttggtcatggcagacgccgaatccatcaggaggctgcccagccggggcggattcgccatgtttgagcggacactcgaccaagccctatgcaaacccatgcaggcccgacgcaatctggacgccctcctcgactacgccctgcgggtgcgcgaccggaacgccctggtggtcctggccactgacgagacggcgattggcgaagggcagatggacgccatccgttccctcggccgcacccatccgctcagcgtggtcagcgtcgccaccgtgaaccccttgtcccctgcctccggcttcccgcgggtggtggacgcctccagcagccgccaggtgcccgccttcctgcgcggggcccgccaaggtcaggatgtggacacccaccggcactaccaggcgctggcactcaaacgcgacctggcccggtcgggcgccacgctgattcgttccggctccagccaaggcatgttcaaccagttcgttcgcctcctgtccacggcccttgcggcctcgggcccttcggctgcgcccagctggctgacggcaggaggcgccctatgaccccggccttgctagccgcccaggcgggcccctttacggccgcccttccccagggcaagcctttgcctccgttggacacctggcggcccttattggtcgcgggaggcctgtgcctgctactggcgctgggccttgctgcgctgattgtcgtcctttccaagccgcgcaaggccgcgcccaccccccaggccaagcatgtgacagccccaagcaaggaacgctggcatacacgcatcgaccaggtggtgaccgaccacgctcagggacgcatcgaccaatcccaagccatgagccagctggcggagatcgtgcgcgcgttcgcctcagaggccagcggccaggacctgaccgcccggaccctggccgaattaagccgacagccccgcacccggagcaaccgaaggcagctcgacctcctgcggcagacgatcgccgctctctatccgcccgaattcgccgaccccagcgtcaaccgtcaggcctatgaggcccaggtgccccaggccgcccagtgggcttcggccctagtggaaggttggcggtgactggtatggcgaacctgacttggcgctggccctggctcatcgcggccctgggcctggccctcatcgtgattgcgtcagccacgctccttctgacccggaggcggggggcggcgagcgcaaaagaccatcccaggcaaggcacggccagcgtgtggagccttgacgaggacctcaagaccgaaaccgcggctaaggcggtccggctctggcggaggatgaaccgtttaggcgcgctcctgctcgccctgagcctggtccttaccacgctgctggccgcccgtccctccgacgtggaccggaacagggagaccggcagaagccgcgacatcgtgctctgcctggatgtctccggctccaccctgccctacgaccgccaagtgatcgaagcctacctgaacctggtcaacgacttccacggcgagcgcatagccctgagcatcttcaactccacctcgcgcacggtcttcccgctgaccgacgactacgacctggtgacccgccagctcaagcaggcggacaccatccttaagggagtgcaaagccaggatgacatcgacaagatgagcgacaagcagtaccaggccatctcggactggctggaaggcacgcaggaccgcaaggacaccacctccctgatcggggatggcctggtctcctgcgcggccatgctgcccggcttctccaccagcgtcaatggcgctggcgccgccgcgaagacccgctcgtcctcgatcgtgctggccaccgacaacgtggtttcaggcaatccgacctacacgctccaggaggccctggagctcacccacgccgccggcatcggagtggacggtctttactcggggccaaagcagagcgagggcgacccccccacccagcagatgcgggccttgatcgaggggcaaggtggagtcttcctcttgcaaggctccgctgattcgatcgcctcgctggtggagcgcattgaacgtcggcatgggggcgacctgcaatccatccgacgctcaagcctggtcgacaccccgcgctggtgggccctggccctgagcctggccctgggcgcctacctgatcgcggtttggaggctgaagcgatgaacggatggacgctggccccctccctgggctggatcgccggcggcgtgttgaccgcccttttgcttgcggctgcggtctgcgggcccatactccgctataggcagcgcgccagctacgacgccagctggctgactgtgggccggcgcagcctgatcgccctggtcatggccctgatcgtactgacgccgagccaggtccaaacgaccaggaaccaggccgttaacgcaaccgacgtctatgtagcggtcgatgtgactggttcaatggccgtccaagacgcccactacggctcccaggacaccatcagccggttggacgccgcgaagcgggccgtttccgacatcacccagtcctacccggacgcctccttcgcggccgtacgcttcggctcctcaggcaccctggatctgccgctcaccccggacggccgcgccttgggcaactgggccaggaacctgacgaccgagcccaccgacctgtcggccggctcaagcctggatgcgccgctcgacccgctggtgctgagtctgaaggagacgaaggaccgtcaccccgatgacagaatcgtgctttacctgatcaccgatggagagcagacctccgccaagagccgacgctcattctccacgctccgggcttatttggatgatgctttcacgctgggagtcggctccgcacagggtggcaaggtgccggtcagttcgcgtacgcccaggcagggggcccagaccggcgcccaggactgggtcaaggacccagccaccgggcaaccgggcatctcgaagatggatgaggggcagctcaaagcgatggccgacgagatgagcggtcactacctgccgattgacgccagccatacgctcaaggacggccctgcggtcaagaccgctcaacgctatcgggtgcaggtgacccacggcgagcgaacccgggtcacgccctgcgtctggccgctggccctgattctcctggccttgctggcctgggagatggtcgactggatccgcacgtcgaggaggctcttatgaacgacggccatcaatcctcactccgcgcgatgaccgggaacgggcccgaaccccgcgccactttcaggctccgggtcatcctcggcgtcctagccttggccctgctggtcgtcagcgggatcgccctatggaacgctcaggccgtcagctcctacaaccaggcgtccgcagccctgagcgaaaacctgagccaagcggccaaacccaccgccgatgccagcaaattgaaggtcgcgcaggggcaagtggacgatctcttcggccaggcaggacagggccgcgcaatcctccttcccggcaccaggcaggccatcgaccgcaacgccgctctctcccgtcagctgaccgccgccttggaccagcttgaccagcagcagtccaacggctcgcaggcccagcagggacagaacgcctcgggagccaagaggaagcaaagccaagagcaacagggactgagcgacgagcaaaggcggaaggtcgaagagatgctcaagcgcaaccaggaccttcaatccgccgctcccgcccctacgagcaagccctcctcccctagcggccagcaggccaaaccctggtgattcgcccctcccgcacgttcgaccacaggccctgagcgcgctgaccgccacattcgaccacattgtccgggcgaggtcgccctgcgccctcccgcagggtggaatgggaccatgagattcataaatcgaaccgggcccaacccccttgagcagggcgcagccggttgcgcctgccacggcatcgtgcaggacagccaagacatcgtgacccagaccgtgcgtcgcagccaggaagccctgaacctgaccgagaccgccataggttcagcccaggcgctggactggcaggggcaggcgggcgaagccttccgagccgcgctggggcgagcggccgaatcggcccgcggtcaggagggcttactggaaggcacggccgcggctgcgagcagggcgcgctcatgagcaagtccatcacgtccacgatcagcggccatggcctgagccaagccgacctggctgagttctgcgcagcggcgaaagccctgtgcgccggcggcgacgacctcaaggcagcggccagcgcttggggttcgctcaggagcgagatgatgacccagagcggaaggctcctgtctgccccctgccgcatgttggcccccactccccccggccacgccgacttcgatttcgtcctcctctcccagcgcggcgatgaccacagcgtcgccttccatcggttgtcggaccaattgtcgtcgatcgcggatgggctgatcacggcttactccctgtactcaagcgccgaggatcggacgagctcgcttatttccaaacttctggacctggccttccaagccgaacccctcgtgtgcggttcctcggccgccgcgatggctatcgctggatcggcatacagcagcctgcgcgcaggaaccgggctccacatcaactgggccgacgtgtcccaccgcaccagaggcagccaggagcgcttcctgaacggtctggcgggttggctgaaacattcctcgccccttggcgtcatcctcgacgacaaggatcaagggccgagggggagcgtaaacgcgatctcaggcaagttctccatcctgacctcggcgctgacccgcctggtgcagggcgacaaactgacggtcacccaagtcgagccgcaagggcgattcctgagtcggtccagctcaataagcgaagccctgtccaatctgcaaacgcttggcgacggcggcaaaggcatcggctacggcacggtcgcggtccaaaagtaccggcacacggacggcagcatcggatgggtggtcaccatccccggcaccgacggcaagcccgactcgccgatgggctgggagcagaatttggagttgatgagctcccggggtgaccagcgcgaacgggccgcttccgcccgcctggtcagtcaagccctggagcgggccggcgtgggcagcaaggaccaggtggccttggtgggccactcccagggagggatcgtggccgcggcggtggcgtcggacctgggcgggcgctacaacatcagccatgtggtcaccgccggctcgccgatcgccaaccacccggtgccctccaagacctgggtcacatccgtggagatggatgatgagctggtctccagcctcgacggttcccgcaacccccaacgcgacagctggctcaccgtgcgcggcagctccggtgccagcggcacccctgtcccccatagcggcacgcaggccgaattaacgcatgggatgagctaccaacgagcggcctggcagaatgccgcaagccaaggcactccggccttgaaccggcatgaccgccatttcaggcagatcacccaaggcagtcttgagggcaccatgtactaccagggccggatgggccattaaacctcccggaaacggccagccgggcgcgacgtgagggtcgcagcggttgaggctctcgcgtagtctagggggcatggacttgaccaccattgaaccagcaatccccttgagcccgttggatgggcgttaccgtcggcagaccgcgcccctagttgaattcctgagcgaagcggccctgaaccgggagcggatcagggtcgaggtcgaatggatgatcctcctggcctgcggttgcgaggagaacggcttccagcctgtcctgcaaggtctggaacccctgagcccggcccaacaggcctacctgcggtccataccggaggacttcggcgagcatggcatcaaggctctggccggcatcgaagccaagacccggcacgatgtcaaggcggtcgaatactacatcgacctccagctggaccaggccccgcagagcctgaagggcggcgagcggctgggccggctcaagcccctcgtccacttcggctgcaccagcgaggacatcaacaacgtcgcttacgcccgttcgatcaaaggcgctgtggagcgggtatggacgcccgctgcccaaggcctggtcgaccttctgtccagcatggcccagcggcaccggtccctgcccttgctggccatgacccacggccagccggccacgcccaccaccctgggcaaggagctggctgtctacgcccaccgcctgcaccggcagctcaagcaaatccagagccaggagtacttaggcaagtggaatggcgccaccggcacttacggtgccttccaggcggcggcccccgaagtggactggatcgccctgtcccaagcgttcgtgactggccgcatgggcctggtttggaacccattgaccacccaaatcgaatcccatgactggcagtccgagctctactcgaccatcagccacgccaacagaatcctgcatggcctggccgttgacatgtggatgtacatttcgcggggggtcttcgcccaggagccagtgaggggggccaccggctcctccacgatgccccacaaggtcaatcccatccgcttcgagaacgcggaggccaacctggaagtctcctgcgccctgctggacagcctggccaccagcttgagcgagagccgctggcagcgtgacctgaccgattcctccacccaacgcaacatcggctcggccctggcacacagcctgttggccctggacaacatgaccgtcggcatgggatcggtccaccccaaccaagaggccatgaaggccgagttggaggacaactgggaggtgttgggcgagccgattcagaccgcgatgagggccgccgccctggaaggccggcccggcatggaccagccctacgagcgggtcaaggagctgatgcggggcaagactattggcaaagcccaggtcgagggcttcatccgggctttgggcttggactcgcaagcccaagaacggctggcccaactgaccccggccacctacacgggcctggccgacgagctggtggatttcgagcgcctatgaaggacagccccaaaacacggaccgaccaagccccgcacatagaggacacgcccccccgccgggttcacgacctaggcgacctgatccgggccacggccggcttggtttcgattgccataatcagcctgattgcggtctacctgcgcggcgtggcctccggcgtcgaatccgacgtgcacaaggccggctctcggatggactggctggccgacgtgcccaccgccctgctccagcagacggtcaccgtcgccgtcgtcatcgccgtgctggtccatctgcttttcagccgcgaatggctccagtccatcaccgccccgctggccctcttctgcggttacgggatcatctggatagcctccaccctcatcgtccactccacctccctggagctgatcaacgccttcagctcccagtcggcgatcggctcgcctgtcctcctgccggacatgtacgcgggcctggcggccttcctaagcgccgccggaccccagcgcatgcgctcatcggtcaagtggggctggaacgccctttatatcgtcgccctgatcatggtggtcatctcagccaactcaatcagcgccgtcctagtctccctcctgctgggccggtcggtcggcatggtgatccgcttcgccgccggtacccagaacaagggcgtctggggagccgatctggtccagacgctcaagtcgatcggtctcgaagtggtcagcctgacacgcacggcctcagccagcgaagaaggcaacctcctggagcccacccttgacgatgacctggtggagtcttcacgcatctatcaagcgcgcaccgttcaaggtcagacgtacacggtttcagtcctagacgggcaactccataccgccggatacttgatgcagctgtggcagtggatcaaactctccggcgtctccatgcgccgcgaccgctcggtacgcgactccaaccagcaccacatggccatgctcctcggcctccgtgagctaggcctgcccgccatgcacccctacggcctagccgagaacggtgaatcctcggtcttcgtcctacgcgacgacgagcgcctgaatccgatcggaccaggccagatgagccaggaagacgcccgatccctgatggactacctagcccaggcccatgcccgtggctacacccatcgacgcatcacccctgacgccctggcccgcgatcaggaggggcgcgccctgctggccggctggcagaacggggaccccgcctcgtcctccgcgaacatggccttggacaaagtccagctgctggctctggccgcctcccgcatcggcactgataccgccattcaaaccgcccggagcgcttggggggacaagaccctgatctctttgattcccttcatccagatggtggctgtgcccaaggccacccgcgcccagggcgagtggagcaagcagaccctgaccggactcagggaggcggtgcgcgccctggccccgaccgacaccacggcacaggatgggccggtggtcctctcccgtttcagcctgcgctccttcctggctctggtccttctggtcgtcgcggtcgtcgtcgtcatcacccaactcaacctccagcaggtcatcgaagcggcgcgcaacgccgatccttggatggcgggcatggccttcggcttcggttgcctgacctgggtcggctgcgccctgaccttgggcgtcttcattgaccgtgacaagcgtcacccgttgaccatcctgatctcgcaggtggcctcctcgttcacctcggtctcgatgccggctggcgtgggccccgccttcgtcaacctccaatacctgcgccgcaacggatacaacaacaccttggccaccgcgatcatgagcgctatagtggcggtccagttcgccaccaccttcctgcttctggtcgtaatcggcctgttcaccggtcgcaacaccctttctggcatgattccgaccaacaccctggtcatcgtgattggcgtggtcgccatcgtaaccgccctggccatggccattccctacacccgccggatgattgtcgaacgactgctgccgattgtggcctcctacgcccggcagctggttgacgtcctcacgcagccccgtcgcctggccctcgccgccctgggcgcggtcatccaatccgcctccctgggtttgagcttctgggccagcttgatggccttcggatggcataccaatgtgtttgaaaccaccttcgtcttcctgctggctaacacgctgggctcggccgtgcccacgcccggcggcctaggcgccattgaggcggtcctgttctcggccttccgcctggccggcgtcccctccgccgtggccatttccgccaccctggtcttccgcctggtcacctattggctgcgcatccccctgggagcgacggccatgagttggctcggcaaacgaaacctgatttgatgcgcctttttccgaggccgactgtgcgcagcagtcgtgaaaataccagcaaaaaccgcgcaaatacggcattcccgaccaaactgcgctaatatcagacatgaacgttgggttcccggtcaaaattgtggggcccctgaacaagaaggatacttctatggcatacaacaagtctgatctggtctccaagatcgcgcagaagtcgaacctgaccaaggctcaggcggaggccgccgtcaacgccttccaggacgtcttcgtcgaggccatgaagtccggcgagggcttgaagctcaccggtctcttctccgctgagcgcgtcaagcgcgccgcccgcacgggtcgcaacccgcgcaccggcgagaccatcaagatccccgcctcctatggcgtgcgcatctcggccggctccctgctgaagaaggctgtgtccaacaagtaaccttcacagttcagccaaagcgcccaccctcctcgcgggggatgggcgcttttactatgctcctgccggaagagcggcgcccacgccgtcgcccctccccctcatcaaggccctcggtgcgggccctcgcgctcagcgcaggtagcgcgagagctcgcggtcaatcagcccgttggaggcgaccacatcgttgttgtgctcccaggagaccggctgaccgttccactggctgagcctgccctgggcctgccagacgacgaccgcacctgccgagaccgccgggatgtcccaagagtggagcatgggctcgaagtaagcgtcgtaggagccgtcggccacccggcacaggtccagggaggtggggcccacgcgcttgatgtcggcggggcggcccgccatctgcgcgaccgttttcagggcgcgctcggactccttgggaaaatatgacatgccgaagctgacgaccgagcctttaagctcacgcttcgtggaaggcatgatcttctcgcgcttgtcaccgacggcggtcctccgcacgcggatggccccctggccctgcgccgccagataggtcaagcccaggaccggagcgtggaccacgcccagaatcggcttggccagcccgtcctcgccgacctcgaacagggagaccgtgatcgtccactcagccatgttgcgcacgtagttgattgagccatcgatatggcccaagcaccagtaacggccaccaggcttgcggtcgctgccttcctcctcccagaagccgtcgcaggggtccgaggcgacgattttggagcggcaatagcggatgagccgttcgtcgatctccgaggcgaagcgggagccgccgtcggcgcccacaggattgcgcagatcgtgggggttgatctggtcttggagggcatgccggcccgcttcgatcgctatgcgcgcggtccgcatggtcaactcacgcaattccatatgctgaaagcctctcttattgcctgcgccggctggcgtcgctggaggcggcctgtcgcgccaaggttgggcctgggtgatacttggaatcctactcagggccggcgaggccgcaagcgcgactggttcagtcgcagaaagcctgaccgctcagccgggcgccacgggcccagtccgccgccttcatggccttctttcccgcagccttgacttgtagcagctccaagggttcgctcttggtgcccacccagacggccctcttacccagcgccaaccggccgggcccgagaccttcgggcgcccgctggtcggcttgggccgggcgggcttgcagcacgtgcagggtcagaccttggtcgccctccccctcgtgcaggaggcaccaggcgccgggctcgggcgtgcaggcacgaatctgccggtccacggcgaaagcgggcttgtcgaaacggatatgcgcgtcctcgccactgatcttgtcagccgtctcgtaggctccctggggctgtggctggggctgcgcgcggccctcgctgaccgcctggaggctggcggccaggagctgggccccatcttcggaaagccgccccaggagttccccggaagtctccctggggccaatctccagtgtcgactgagccaggatcggcccctcgtccatacctttcgtcaggcggaagaccgtcgctccggtcacccggtcaccggcccagagcgcccgctggaccggcgcggccccccgccacaagggcaggagggagaagtgcaggttgtaccagccatagtccagggcgtccaagaccggctgccgcagaatccgcccgtaagccacgaccgcgccgcaagtggcaccggtcgctttgacctcttcggggaatgaagggtcacgcgggttggactccagcacgggaatccccagctcttgggccgcctgcttgacggggctaggcgccaacctcctgcctcgaccttggggcgcatcaggccgggtcaggacagcagccatatggaagtgctcggggtccccggccagaagccgtagggccggcaccgccacctgcggcgtgcctgcgaataggatgctcaagggttcactcattgccatacccctctcatgtatagttatgcgccgctccgccccctgggtttggcggcggctcatcgggcctgcgggatgcccgcgcccatctcgattagcgcggttctgaacgatggggtcctcgaagccgcaatgccctcatgcaatcatgcgccctcgacgcttaaggccatgtgatacggcaggctcaggtcagatccttggggtccatgcggaagcgaagctcgccacgccccctggaagccgcgaaagcgctgactgcggtccgcagacgctctgccaactcgtcacgacgctcgggcagcacgcgcaccagggcgcgcacccggtcgcccactccatcgagggcccggtccgtgagtttggactcggctggtatcgggaccggccccatcagaccgggaacctcctccttccccacgaggatcggaggcaggtcaccaccggcgagagccccaatcgcgtccaaggcgaacatgaccgggtcacgaccgccccagaccgtcgccgtggcgactttaggcggaagtccagcctgggagcggtcatccagctcagccgccgccagcaggtccggccgccaagtgatcaaggcttgcgccagggccgggtcgctttcccctaggattaaagcctgtccgccttcggctcggggcttgcagagcgctaccacgcgcatccacgcggtcagcgtgtccaaacgggcatcaatgccaagcgcgtacagggaggtccaagcgtcaaggatcgcgacggcctggtagccgaccgaccccggaatcgagcctggggccgtgatgactggctcagccccgggcgtggagatgaccagccgggggcgctggtcgatggattcgacgatgccccggggctggttgggcgtggagatgacgatgggaacgccgcgcaggaggaggcggagctccgcagctgtgccggccgcgcctacccgcacggtccgcagctgttcgcagccgcaggtcttgcaatgccagttcacggcggcctcgccgcaccaagagcagcggggcgcccgcccccggcctgcggcggacaggggtcccgcgcagcgcgggcagcgggcttgcaggtggcaggaagcgcaagagagggactgggtcacgccgtcttggggaatggaaaggaggacgggaccgagttccaaggccttgacgagcacggcgaccgctgtgtgggggacgcgggcgccgatggccgggtcggcaagcctggccagctcttggcgattaagccagcgcacccagggcatccgcgcgtcgactgcccggcgctcaggttcgatggcttgaatgggaccggtgacgccggatgcggcctcccacgcctccggcgaacactcccactgggaacgggctgagcgggcgtgccccaaactcagaaagacgccccgatgggctttcgcccgcaagcggaggacgccgcgggcgttggcgtagggggtcatcccgtcggcgctctgataggccgcatcgtccagaatcatgaagagggccgggccttcgaccggagcgtacatggcggcccgcaagccgatgatgcagggcacctgcccggtggcgagggccaggtaggagcggtaacgctccgccggaggcatggacgagcccatcagggcgaagtctcccgaccagcccccctggccgtccgggtctggggagaatggcttcaagcccaatgattgcaaggcttgagagaggcttgccatgtgccgggcatcaggtaagacggccactgcctgcctgcccgctcccagagccgtgcccaacgcccaagccatcactcgctcccggcctccgaggccaggcagggcgtctaagacgaatgacgcgaaaccagggaagcccagcgcatcgtccaaacccgtcagccccgggtaagcctcctgcaagcgtctgccgagggtctccaggccatccccagggcgctgggtccgcgcgggcttcccgtcgcccgccgcaagggcgagggcctcttgctcctgctcgattcgggctaccctgggcggcagcgccagacgcaggatgttagctcttgttcccccgtaagccttggcgatggcagcgatgtcccggcgcatggaggcggagaccaccacctgcttggccaccacccgctcgatgaatttgagcgcctcggtaggggcgtcgctgtgttgggagcgggcccagatgacaccgttcaccagctgcctgccgaagcgaacgcggaccaagacaccaggcttggcggcctcgtcgtcccgctcatccaccaggtagtcgaaggtccgccccaagtggggtgcctgcacgtccaggaccacccgggcgataggaagccctgcggccgcgtgcggcaccctcttgcgcgaaggacggcggcgcggaggcgccagcccgtcaagcgccagctgctcggcttgaggttggctcaaggccctccttcataagatcaggcgagctcggccaccgctgctttcagctcgtccaccttgtcggtacgctcccaagtgaagtccgggtcggtgcggccgaaatgtccgtatgcggcggtcttggagtagatgggcctcaagaggtccagctcgtcgatgatggccgccgggcgcaggtcgaagaccttacgcaccgcttgctgaatctgctcgcgcgtgacgccctgctcggtgccgtaggtctccacattgaccgaaaccgggtcagccacgccaatcgcgtacgccacctgcacctcgaccttgtgggccaggcctgcggccacgatgttcttggccacccagcgggaggcgtaggccgcggagcggtccaccttcgtcggatccttgccggagaaggcgccgccgccatggtgggccgcgccaccgtaggtgtcgacgatgatcttgcgccccgtcaaaccagcgtcagccgctgggcctccgaggacgaacgaaccggtcgggttgaccaggagcctgtagctgccgtgctccaccgtccgtccgcatacttcatccaggaccggctgaatgacctcgcgccgcagttgctcttccagccagtcgcgcttgacgtccgggtcgtgctgggtggagatcagcacggtctccacgctcacgggccggtcgttctcgtcgtattcaatcgtcacctgggtcttgccgtcagggcgcagaccggggacgatgttctccttgcgcacctgggccagccggtatgccatgcgctgggccaggtagataggcaggggcatcagcacgtcggtctcgtcgcaggcgtaaccgaacatgacgccctgatctccggcgccttgcacctcgtagcgctcctcgcgggtggcgacgctctcctcagcgccctggaggcgggccacgccctggttgatctcggggctctgctcgctgatcgagacggtgacaccgcaggagtcggcatccaggccgatccgggagctggtgtatccgatcctgcgcagaaccgaacggacctgctgctggatgtccgtgtagccggccgagctgacctcaccaaacacgaagaaaagaccggtcgctgcggaggtctcgaccgccacgtgcgaatgcgggtcttgggcgagcaggtcatccagaatcgcgtccgaaacctggtcgcagaccttgtccgggtggccttcggtcaccgattcagctgtaatcaaccgtcgttctgccatatgtgaaaccccacactccttctattgcacatcccgtccgcaggcgtgcctaacccgcctgcccccaatgcctgccaggctttagttgccttcggtcaggtcatcctcgcccagggtctcctccaggagcccttcgttgatctcgcggaaggcgatggacaaaggcttctcttggttctggtactcgaccaagggacccacgttctgcaggaggccctcgttgagctgggtgaagtaggagttgatctgccgggcgcgcttggcggcgaaaatcgagagcgcgtactgggagtcggtgtgctccatcagctcgtcgatagaggggttagcgaaaccctggggctgcggctcagtgccaaaagatgccatgaaatgattctcctatgcggtgggtgcatgtctgttcaacttcgacgattttaccgccccgcctcgatttatgcgcagctggtgcgctcggcgtagtcagtccagtccatactcccccgcgatgaccctccacagggcgtccgccgcctgctcgaccgtgtcattgacgatgacgacgtcgaactcgccctgactggccatctccacccgggcggtctccaaacgcttgcgccgctgttgggcgtcctcggttccgcgctcgtccaggcgcttgatcaagtcgtcgaaggaggggggcgccaggaagacgtagaccacgtccagccccaggccttccgcgcattggcggacgcggtgggccccctgaaggtcaatctccagaatcgtcggcacgccttgggccatgtgatccaggaccggctgcaagggggtgccgtagtgagacatgccgtggaccagcgcggtctccaggaactcccccgccgcctgacgacgggcgaactcctgctcgctcatgaaccagtagttgacgccgtcacgctcaccagggcgtggggcccgggtcgtggcggacaccgaaacccaaacccgcggatggacctgacgcaggcgggcctcaacggtacccttgcccacggctgtggggccggtgagcacgaccaggcgccgacgggcatgagagccctgctcgtcccccaggtctggggcctgcgccgcctgatcgccgcctgccgtcctcgtcgacaccgtcctgcccatcgccactgctcactccccgccgtatgtgtctttgtttaacggccgcagtgccacagccaggtttacaacccgacggtggccccgcttggccttacctcaagactacgctgggccagcgaaccggcgtggggcggcgcaatcccttagccttgctccttctccaactcgaagaggaggcgggcatgctcctggatgctcatgacctggtagtcgccctgcttgaccgcctcaatcgccatcaaaacggccgacaactgggtggccgtcgtgaattgcggcaggtcggcggccactgcggccgcgcggatcaggtagccgtcggagcgggagtcccgggtcgaaggcgtgttcagcaccatgtcaatcgcgccctgctcaatcagctccaccgcattgctccccaggcgcttgagcgaaggatcctggggctcgcgggcctcggggctgtcgctgattttgccgaccaaggccacgtcgatcccgtatcggcgcaggactgaagcagtgccctgggtggcgcagatggagaagcccagctcgtgcaggcggctggcgatcatcggcagctggcgtttgtcggcgtcgttgaccgacaggaagaccctgccggaggtcggcagccctccctggtaggcggccagctggctcttggcgaaggcgtggggaaagtcccggtcgaagcccatgacttcgccggtcgaatgcatctccggccccagcagcacgtccacgctcttgcccaccggcgtgcggaagcgcttgaagggcaggaccgcctccttgaccgccaccggctgcccaggtcggctggtccctccgtcattgctgggcagcaggaggccacgggcgcgctggtcagcaatcgattcacccaccatgatccgggccgcggccttggccagggccgtgccggtggccttggaggcgaacggcacggtccgcgaggcgcgcggattggcttcgatcacgtacagggtgttggccatgaaagcgaactgcacgttgagcaggcccctcaccccgcagccttcggctatagccagcgtggcctcgcgcaggcgggtgatctgcttgtccgaaagcgtggaaggaggcaaggtgcaggaggcgtcgcccgagtgcacgccggcctcctccacatgctccatgatgccgccgatgtagagttcgcgcccatcgtaaagggcatccacgtctatctcgatggcgtcttgcaggaatttatcgatcagcaagggcgaaggcagccggccggagaccaccgtatccgcctgagcctgactcagggcgcgctccacgtacttgcccagctgggcgtcgtcatagacgatctccataccgcgcccgcccagcacgtaggagggccgcaccagcaccgggtagccaatggtgtgggccgcgtgctgggcctccaccagcgacatggccgtgccgtagcggggggcgttcaggccctcgcgctccaagacctgcccgaaaagctcacggttctccgccaggtcgatcgactcggggctggtgcccaggatcggcacgccagcctccttgagccgggccgccagggacaagggcgtctgcccgcccagctgcacgatgacccccttgaccggacccattcgcagctcggcccggtagatctccagcacgtcctcgaaggtcagcggttcgaagtagagcctgtcggacacatcgtaatcggtcgaaacggtctcgggattgcagttgaccataatcgtgtcgtagtcccggcccagctcctggaccgcgtgcacgcaagtgtagtcaaactccaccccttgcccgatccggttgggccccgaacccaggatgatgaccgcctcgcgatcgcggggcttcaactcgctctcctcggcataggtcgagtagtagtaaggggtggctgcgtcgaactcggccgcgcacgtgtccacggtcttgtagaccggacggatcccgtagttccagcggagttcacggatcaccgtctcgccctgctcgcccatccccctcaggcgggagatttgcaaatcggacaggcccgccctcttcgcccggcgcatgaagtcatcgtccaggaagtcagcctcgcgcaccgccaaagccagctggttgatctggctgatctgctccaggaaccaagggtcgattttcgtggcttggaagacctcgtcgacgctggcaccgccccaaaaggccctctgaatatacaggtagcgccgctccgtaggcctggccatggcttccaggagcctgtcgacctcagcccggtcgggtcgttcgccctcccaggagaagcccatgttgcgcttgtcgaccgagcgcatggccttgcccaaggactcctggaaggaaccggccagggccatggactcgcccaccgacttcatcgaggtggtcagcgcgtcatcggcgccagggaacttctcgaaggcgaagcggggcaccttggtgaccacatagtcgatggccggctcgaaggaggcgggggtggagcgggtgatgtcgttggagatctcgtccagggtgtaacccagggccagcttggtggcgatcttggcgatcgggaaaccggtggccttggaagccagggcggatgaacgggagacgcgcgggttcatctcgatgacgatgatgcggccgttgctcgggttgagcgcgaactggatgttgcagcctccggtctcgacgcccacgccacggatgatcgcgatgccgatgtcccgcatccgctggtactcgcggtcggtcagcgtgaagaccggggccacggtcacggagtcgccggtgtgcacccctacagggtccacgttctcgattgggcagacgacgaccacgttgtccttgcggtcgcgcatgagctcaagctcgtactccttccagccttcgatgccctcctccagcaggacctcgtttgtgggcgaatagtggatgccggccccggcgatccgatgaagctcctcatggtcgtgggctatgcccgaaccgaggccacccatcgtgaaggagggacgaaccacgagcgggaagcccagctcggcggcggcagcgtccgcctcctccaggctgtgggctatgcgggacttggctgattcagcgcctgcggcagcgaccacctccttgaacatctgccgatcttcgcctcggtcgatggcctggagtgaggcgccgatcagctctaccccatagcgctccaagaccccggcgcgccccagctcctccgcggcgttcagggccgtctgcccgcccagcgtgggcaggagggcgtcggggcgctccttggcgatgatccgctccaggatgtcgcggtcgatcggctcgatgtaggtggcgtcggccagttcagggtcggtcatgatggtggccgggttggagttgaccaggatcacccggatgccctcctccttcaagacccggcaggcctgggtgcccgaataatcgaactccgcggcctggccgatgacgatcggcccggagccgatgaccatgactgaatggatgtcttcgcgcttaggcatgggccgcgtccccctttgagctgatcatcaaatccacgaaacggtcgaacaggtagccggcgtcgtgcgggccggccgccgcctccgggtggtactgcacggagaaggccggtatgtccaggcattcgaggccttcgaccacctggtcgttcaggtccacgtgggagacgcggacccgtccgtagcggccggaatcatacggggcctggaaggcctcgccaatcggggcccgcactgcgaacccgtggttgtgggccgtgatcgccaccttgccggtcttgagatccatgactggctggttgactccccgatgcccgaacttgagcttgtaggtccctaatcccagggcccgccccaggagctggtggccgaagcagatgccgaagcagggatggcctgcgtccaagacctggcgcaggagggccgtctcccgctcggccgcgctggggtcgcccggaccgttggagaagaagacgccgtccggctccagggcctcgatctcccccaggctgctgctggccggcagcacgtgcacccggcagccccgttcagccagaagctggggcgtcatcgccttgatgcccaggtccatggccgccaccgtgcaacgtggggactttccttgccactggccgctgggctcaatcgtgtaggctgcggcggcgctgacttcatcggtcaggtgggcgccggccatcttgggcgcccgcctcacccgatccaggagttcggcgattgtcagcggccggccatcctcggccaggagcgtcgggccggaaaaaataccggcccgcatggcgcccgctgaacgcaggtgccgcacgagccggcgcgtatctatgtggctgatgcccacaaccccttggtcgcgtaaatcatcgtccaaggagccttcggatctccaattgctgaccctgggcgagggttccctcaccacgtacccgcaaacccagatccggccggactcaccgtcctgcccgttgaccccggtatctcctatgtgggggaaggtctgcaccacgatctgatggtcgtaggaggggtccgtcagcgtttcctgataccccgtcatccccgtagtaaacacgatttcaccgtatgtctggcccagtgcgccgtaagagtcacctgcgtacgcttgaccgtcttccaggagcaagagggccaattgattgagatgacgatcggctgcaatggctttggcatcttgtagattcacccaaaccccttaatcgcagcggatgttcgcagtaactttactgtgggccctggatcaggcgatgaacggccgaatgccaggctttcgcgcgcatgcgacgaacgcggagaggcaggcgaggatcagtgattgccgttgaagtagaggtacctggtgtccagggtgccgttggccttctgttcctcgccggtgttgacgctgtcgccgtccggcatccccgaccagttcgctatggaattgccgaaaatcttgatcgtgtaaccggtgggcggcagggtgtgcgacttcgcccacacggtcaggtcccgctccacccggtccacgctcgactgcggcggcagcttcttcgtaggagcgtacatctggatggaggtctccatgaccctgccccgctcccccaggttgtcgctctgctcggtgttgaggatgtcttgctcgaacatggggcgcagcctttgcgcgctcaggttctcgccgctcgtgtacgcgttgatgatgtcgtcaaagtcgggcccctcgaactgcaaatagagccagggcgtctcgtatcccgctgagcgggtcttggaaatggcctcaggccgcaggccgagcaggccgagcgccttggcttcgccgcccaggaaggcgttgaactggtcgtactcctgctgccaggcccggtagtacaggccgctgatgatggaggccttgatgttctgccagagatcctccggatcgcctttgatgtggccttgcttgtccattttcacctggaccgccacagtgaactgcgggtcggcgcaggacacgttcacctgggctccgctgctggtaggccacaccgcgttcaccttcacttccgtgttccagtggtcgtgcatataggagaccaccatccgcttgatctcctcctgctggtcttggaccggctggcgcatgctatccgagtcctcaggcttgaagcccccaccggtgtagtcctgcaccggggtcatggccaccttctccggcaaccgcatggtggagccgtcggatggcttggagcgtcccatgcggatctcgatgccgcccagcgagcaaccgctcagcagccccaccaccagcaggcaggacagcagggcgacgccacggcgcaggaggggtttgaagcctcgcgctgaacctgtcatgactcgaccatcccctattacgcagccaactcccgtcgattcccaggctcggcccggaccagcagcttggaagcccgggcgggacgctgggatctcagcccagttcggggggaagctccaaactcagatcatccaaggaggcaccgggggaggcggcctcgtcaggccgttcggccggcgcctcggcatcttcagcctggcttgccgcggtctcgctggcggcgggcccggaagcttcggcctgcgcgccttccgcccggccaggatcggagccttcagtttcagattctgcggcctcggactgcttggcctcagcctgggcggcctccgcctcggctaaatcggagatgcgagcggcctcttcggcgcgtttccgggccgcgtctgcatcctcctccagggacggctgatcgcgctcgacggccgagagcaagccatgcacaaaggccggcgtatccgaatcgcaaagggtcttggccagggtgagcgcctcgtcaatggccaccttgctgggtatctccgggttatagagcatctcccagcaggcgattctcaggatgttgcggtcaatcaccgccatccgccgcaccggccaggaggtcgagcgctcgttcaggatccgattgatgtcgtcgaagtgtttggccacgccgtgcacgatctggattgcatactcaggcagtggcgtctgggccccggggcgcttgatgcgctcctggagcagggattcgatgtcctgccctttctcatccgcttcatacagtgtgttcaacgcccgcttacgggccgtggatcgtgccatctaagttgggccctcagttctcgcggcccaggtatgaaccatccctggtatccaccttgaccttctcgccctcgcccacgaacaggggcacttggatctcggcgccggtctcgacggtggcgggcttggtgccggcgttggaacggttgccctggacgccgggctcggtctgggtgacggtcagaatcacggaggcgggaagctccacggacagcggggtgccgtcatggaaggagatcacgcagtcggtgccctccagcaggtaccgctcctgatcgccgatcagagcctccgggatgttcacctgctcgtaggtggacatgtccatgaaaacgaaggcgtcgccgtcccggtaggagtactgcatggagcggttgtcgacggtctcgaactccatcttcatgcccgcgttgaatgtacggtccacgatcttgcctgaaagcacgtctttgatcgtcgtccgcacgaaagccggacccttgccgggcttgacgtgctggaacttgatgacggtccacagcttgccgtccaggttgatgaccgacccattcttgatgtcattggaagtctgcgccactgcttgccaccttctcttttctcgcttttgcaacgcttttctggaaacgcctcagggccccgcagggctgccggcgcgcatacctgttcattatgccacggcaggtgaacaccactgcggagccgttcctccaaacgaaacaaggccccgggcgcactgagcgctccggggccttggacggccgctaggccgtcagccgttactgtcctggtactactcgatcaccttggtgacacggcctgaaccgaccgtgtggccaccctcgcggactgcgaaggtcaggccttcctccatagcgacgggctgaatcagctcgacggtgaaggtcgcgtggtcgccgggctgaaccatctcgacgccctcgggcagcgtgatgacgccggtgacgtcggtggtgcggaagtagaactgcggacggtagttggagaagaacggcgagtgacggccaccctcatccttggtcagcacgtagacctcgccctcgaacttgtggtggggggtcacggtgccgggagcggccacaacctggccacgctcgacatcctcacggccaacgccgcgcaggagcagaccggtgttgtcgccagcctcggcctcgtccatctgcttgtggaaggtctcgatcgaggtgacggtcgtggactgggtgtcacggatgccgacgatctccacgttggagttgacgggcagcttgccgcgctcgacacgaccggtcaccacggtgccgcggccggagatggtgaagacgtcctcgatgggcatcaggaagggcttgtccagatcgtggacaggggtggggatgtaatcgtcgaccgcatccatcagatccttgatggtctggacccacttgtcgtgatcgggggcgtcatcgtgcagggcgccgtaggcggaggtacggatgacggggcaatcgcggtcgaagccgttctcgtccaggagatcgcggacctcttcctcgaccagctcaatcagctcgtcatcgtcgaccatgtcgcacttgttcagggcgacgaggatcttcggcacgccgacctgacgggcgagcaggacgtgctcgcgggtctgggccatggggccatcggtggcggcgaccacgaggatggcgccatccatctgagcggcaccggtgatcatgttcttcacgaagtcagcgtggccagggcaatcgacgtgcgcatagtggcgcttctcggtctggtactcaatgtgcgcgatgttaatcgtgatgccgcggttcttctcctcaggcgcggcgtcaatctgatcgaaatcgtactcggggttgatgtccgggtactcctcatgcagcaccttggagatggccgcggtcagagtggtcttaccatgatcgacgtggccgatggtgccgatgttcacgtgcggcttagtccgctcgtacttttcctttgccattgtgttttgtcctcctggacgtttcgtagtttgcctgtgcgaaccacgcacaagacactcgctacatattactgggtaattgggatgttcgccacttatgccctccgcccagtcagcgttacagagtatagcgccaaccggtgacaggaggcgggttcaagcccgccccctgtctgggctcaggcgaggttcactcgccgcgctgggccttgatgatctcatcggagaccgtcttgggaacctctgcgtaggagtccatctgcatggtgaacatggcgcggccctgggtcttggaccgcaggtcgccgatgtagccgaacatctcggacagcggcaccttcgcatcaatgaccttgacaccggtggcatcggtcatggactggatggagccacgacgggagttgatgtcgcccatcacatcgcccatgtactcctcgggggtgcgcacctcaacggccataatcggctccaggatgacgggcttggccttgggggcggcctccttgaagcacatggagccagcgatcttgaaggccatctcggaggagtcgacctcgtggatctggccgtcggtgacggtcgccttgacgcccacgaccgggaagccggccaggatgccggactccatggcctcgcgcacacctgcatcgatcgaggggatgaactccttggtgatgtggcctccggtgaccttgttctcgaactcgtaggtctcgccttcggcggtgtccaggggctcgaagttcatgaggaccttcgcgaactggccggagccacccgtctgcttcttgtgggtgtactcctggttcatgacggccttgcggatggtctcgcggtaagccacctgaggcttgcccacgttgcagtccacgtggaactcgcggcgcatgcggtccacgaggatgtcgagctggagctcgcccatgccggagatcagggtctggccggactcttcgtcggtcttgacctggaatgtgggatcctcctccgaaagcttctggagggcgatgcccatcttctcctggtcggccttggtcttaggctccacggccagctggatcacaggatccgggaaggtcatggactccagcgcgatcgggtccttctcgtcgcacagggtatcgccggtcgtgacgttcttcaggccgacgaaggcgtagatgttgcccgcgatggcctcgtcgaccgggttctccttgttggaggacatctggaagagcttgccgatgcgctccttcttgcccttggtggagtccaggacggtatcgccttgggcaaccctgccggagtagacgcgcacgtagatgagcttgccgtagaaggggtgggtggcgaccttgaaggccagggcggagaagggctcgtccacggtgggcttacgatcgatctcgaccgactcgtcgccgaccttgtaacccttgatcgcgggtacatcctcggggctgggcaggtaatccaccacagcgtcgagcatgggctgcacgcccttgtccttgaaggcggacccgcagaagactgggaaggcctcctgggcgatcgtcatcttgcgcacggccgtgcggatctcgggctggctgatctcctcgccgcccaggtacttctccaggagggcctcgtcggactcggcgacggcctcgatcagctgggtgtggtattcctcggcgcgatccttcaggtcatcggggatgtcgatggtctcgtagtgggcgcccagatcctggccgtccttccagtagtaggccaccatgcgcaccaggtccacgacgccgcggaagtcgttctccgcgccgatgggcagctgcatgaccaggggcttgacgcccagcttctccttgatggtgtccaccgagtagtagaagtcggcgcccagcttgtccatcttgttgatgaagcagatgcggggcacgccatacttatcggcctgccgccagacggtctcggactggggctccacgccctccttgccgtcgaagaccgccacagcgccatcgaggacgcgcaaagagcgctccacctcggccgtgaagtccacgtggccgggggtgtcgatgatgttgatctggtagcggttctcggggtcgtgggactgccggttccagaaggcggtgatggcggcggacgtgatggtgatgccgcgctctttctcctggtccatccagtccatcgtcgaggcgccgtcgtgggtctcgccgatcttgtagttcacgcccgtgtagtacagaatgcgttcggtcgtggtggtcttgccggcatcgatgtgagccatgatgccgatattgcggaccttcgtgaggtccgtgagcacgtcttgtgccataatcctagttctctcgctctcttggcttaccagcgatagtgggcgaaggccttgttcgcctcagccatcttgtgcgtgtcctcacgccgcttgacggaggcacccaggccgttggaggcgtccaggatctcattggccagacgctcggccatggtcttctcgcggcgggccctgctgaagtcagtcagccagcgcagggagagcgtattcgcgcggttgggcttgacctcgacaggcacctggtaggtggcgccgccgactcggcgggaacgaacctccagggagggacggatgttgtccagggcgcgcttcaacaccgcgacgggctcctggtcggtcttggccttgacttgctccaaagccgagtagacgatgtcctcggcgatggacttcttgccatcgaggaggatcttgttgatcagctgcgcgacgaccgtcgaaccatagatcgggtcgggcagcagctggtgcttcttagctggtcctttgcgtgacatgcttacttagccctctttgctccgtacagggaacgaccctgcttgcgatccttgacaccctgcgtatcgagcgctccgcgcacgatgtggtagcgcacacccggcaggtccttgacacgaccaccgcgcacgagcacgatggagtgctcctgcaggttgtggccttcgccggggatgtaggcgctgacctcgacgccggagctcaggcgcacacgggcgaccttacgcaacgccgaattcggcttcttgggggtggtggtgtacacacgggtgcagacgccgcgacgcagcgggctgcccttcaaggccagagtctttgacttactcttcttggccttgcgtcctttacggacgagctgttcaattgttggcaactgattctctccgattcctggatttcttacctgttcgccgttcgtgaagccgccaccctgcagctccgacccaaccgaacccgttcggggagtaaaagcagccacagtccaccggcccgatggtccgcaaccctctcgctggccgcattgctgcgcgcgatcatacggattggcggaatatcccagcgtccacccctgtcacataaggcatgccgctggcacacacaatatttaatatagcacgtccccccacctaccgcatccagcgagctcatcgcgcttatcggctccttggaacggccgctggcgggccaagcgcgaaggcattctgggcttgaccggagacgacagctcccgtagggggacctggacatcaaccggggcgacgacacgatggcggccttgcatctcccacctggccccagactcacccagggcgagcgagcccccattatgaagtcatagagcgatccggcgatcgcgtcacccgtccgccaccgccgtaagacccgccgacggacgcgaatcaaaccatggacggcccatcagcccaggcgtcgctccaggtatgcgcgtaggacgatggcctggttgagctccttgtccttggccccatagagcagggtcagagtgggttgcgatgaggccaggtccaggagttgccctacggcctgggggttggcgtccagctctgcctggtagcgctgggcgaactggtcgaagcgctccgggtcatgatgccaccaccggcgtaaatcggcgctaggcgcaacctccttgagccacaagtccaagcccgctttagccttggacaggcctcggggccagagccgatccaccagcaccctgaacccatccgccttgtccgcggcctcataaacccgcttaatccgtacttcgcccatgtcagcccgcctcctacggcccatcgtaacgcccgggacggcgccagccaagagcccaccagcgccgcgacgcgccgaccgggcagtcatcccccaccccttgccagctcaatcacgcgaacctacagtgtgaagcagacccatccgccacaccgcgaggaggcagcatggtcacttcatcccatcaatcgacttccggtcaggcgcgggcgcggcgctcccgcctgtggctgcccgcccaacccggagcctgggtcatggccctcctaccgaccctgggcggctgcctgatagcccgtttgagttggcacagcctcttgctcttgctcgcttggaccctggcttactgcacccagttcaccgtcgcccgctggatcgcctcccgcctggcccgccgctaccaggccccggcgctgacatacgcgggggcgacggccctgcttggcatctgtctgctggtggcggcccccggtttatcccgctggatccccgtctacctgctgctggccgtcgtctctttcctggccgcttacctgcgtcgggagcgttccctatggaatgacgcggacgcggtcatcgccgcctccctcacctgtctgatggcttcatcgctcaccgacgccccggccgccacgctccaagcgagcggaagcgcgggccgaacttactgggcctgccagggcaatccggcggtctactgcttcgccgatggcccgctgaccaggcaggcgctgccggccgcaggcctggttgccgccatcgtcttcgctctcggtgagttcggctccgtactgttcgttaaaaccatgatccgcgagcgcgggaagcgcacctactacctggcttcggtaggatggaatatcctgttggtggccgccagcctaccgctgacgcggatcctaggaccctggcctcccctggtggcactgctcctgctggcgcgcgccgcagcgataccgccgctggcgccacaaggttggaaaccggctcgagtaggggccgtggaggccgtggcctcgctagtggtcttcgcgctggcgctggccttggcctcggcccttgcttgagcgcgagcgccacgcattcacttactggcgaagaggcctttgaccctggccatgaatgactgcccattggggtccttggctgggcgggcttgctggtccttcccttccttcgacgcctgccgctccacaccctccagtaggtaggtgaactgtactttattcacattcgtgttctcaggcgccacgaaggagtggggcttgaacccgacccccagtttcttgtcaatcgcctgttggatgccgtccaggaccttccggtccatcccttgcaccgactgtgccagctgggcagacccatcggccagagcctgcgcgccaactccagcggcgcccagagccgaattcaaggacttgacaccagcgtccacctgggccgctccccctgccagcgacccagccccggttcccaaggcatccatgggcgcgcccgaggcctgtcctaaagcaccgctcaaagcgcccagaccctggtcgagttggacggcgcccgaggccaggcttccgggccggctggcatcgaactgcccgtccagacgggccgaaccctcagcaagctgccccatgccccgcgaaagcgcctgggcgccttgcgaagcggtcgccgcaccctgggcagccgactggattccagcgttcaaagctcctgtgcctgtggccaacgggccgtactggttggatgcctgagcgagcgcctggctggctcccgtggccgcgcccgcctgcgccgaagcggcggaaagagcctgcaccgaagcgttgagcgcggccagctttgtcggatcgctcggagaggcggcgaaggcggacaaggcggtctgatatgctccctgggccgcagtcagccgagcggcggcggtttgggcagcggtcacctgggcctgatgctcctgctggagcccctgctggtactgcccactgccggttgccagagtccgcccggccgcagcgagggatggctgtccactgttgggatcgcccgtgttcaaaccagcattcaagcgggccagaccttgggccagtgagcctgctccgccctggcttgcgacgatgccggagcgtaggctcctccagccgtcgctgaaagtgggcgacgcggggttaccgctcgacattgacagctgtcgggccagggccgacgagccttcgcttagggctccggctccccgacccgcgctcttgaggccgtcgcccaggctggagataccacctgccagctgcttcgacccggctcgcagagctccggaaccttgggaaagagaccccgcgcccgattggagggcctgagcgcccgccgccaggctgccggcgccacctgccaactgactggtcgccccctccagctggcccgtctgctcactaagctgggtcgtgtcctcatcgctcacattcagggccatgttcaaaggcatggccgagacctgccaacctgagtagtggaaatcgtgggccttacctgagatgtggaaagccttggactggcccggcaggaccatcgccgccagaaccgtgttgccgccagcgtgagccaaggtcgcaccaccgtcatccgtgacctcgaaggcgtcctgggggaaggtcccctgggcttgcaggacgtagcccgtcgcgaagtcggagacgggtccggccccggtttcgccgctgaccgtcaacgtcaggtccaagtcgccattcaccccggccacctgactgggtttgaggaccttaccgccctgccgaaagtccacgcgcaatcgccagggcagacgcgtggaagcgggcagattcccctggtagtagaagggctgatcggcggcgggcgtgaaggagaccgcgccatcggctacggccagccgctcgtcggtggtcaggttggtgacagactggtaggagccgaggtcgctgattctcctggccttgccgggcttgaaggagttgaccacatagacgccttgggtctggcctgtggacgaagccttgacatagatgacctcatccttgccaccagagccgctggaccgcgtcgcgcccgcctcttgcacagctggttgccccgccacttgccccccgccggagcgggcccctgcggtcggcgccgccgcgaacagggcggtcgctaaggctaggcaagcggccaaagcagccacgcccgcccgccaggcccgccgcaccgaaatgattgacttcatcatccttgccttccttcctgtggtaccgccgcagctcccagggtccccagccgtccgggctcaccagggtcaggcagtcgcccacccgcctcgccgccctgcccggaggccgtcgcgaaccgcagcccgatcgaggtgtgccgaataagtccgtcgaaaacgcgaagcaggcagggcaggaggaggaacataaggaccatggcgaagaaagcgccccgggccaggagggtcccaagctcggagatgacgccgttcgtggcgatcagccggacggccaccccagcgcacaccaggattgacgaggaggtcagtatcgtgatggccgagccctggatggcttggcggctggcgtccttggcgccgacctgggcccggcgctccaagtattcgcgggtgtagatgatcgcgtaatcgacggccgcgcccaactggactgagtcgatgaccaggtagccgatgtaattaatggtctgcccagtgaagtatggaaccgccaggttcatccagatggaagcctcaatggccaacaggacaaccaggggtatggtcaacgagcgcgtcatgaacatcaggatcaaagcgatcgagccgattgagaagagcgagactttcaaggaatcctgacggaccgtatcgcgcaggtcgtataaggagacggtcgagccgatcagacggtagtcggagccgtagcggttggccagcaggcggcggaccgatgagaccatatcgtaggccgtgtcggaatcggactccacgtcaagggagaccaccatgcgcgaccagccgtggttcatcacctgcttgagcgtggcctcaggcgctacctggaccggggtggcgcggccggcgaccgtgatgtaagaagtgaccgagttgacatggttcatggctttcaggtcgtccagcgtggcttgctccttcgcccaatggccttcgggcaccatgaccacccaggtctcctcctgtccgaaaacctgactgatccgcgccgactcccggccctgctggctggcggggttgatgaagtccgacgacccgtagacgaaattagtccggctctgggccaggtaggagggcagggccagggccacgaccaccagggcggcgggaatcatgacccgctggcacaagcgcgcgaaacccccgaaagagggcatcagataacggtgctccaaggccttgagcggtttgagcatgagcagaatcaggcagggcatgagcagcatcaccgacaggaagctgaagacgatgcccttggccaggaccaggcccatgttcacgcctacgccaaagcgcatgacggtcagcgagaggaatccgaagaaggtgaccgccgccgaggacaggaccacggagaacccctttaccatcgcgtaggccatcgcctcctccgggtcggcgcgtagggcctcctgccttcggaaggtgtgcaggagcacgatcgcgtagtccatcgaaaccgccagctggaggaccgcgccgcagatctggctgacgaaggatatgtcgggcaggaggatgttcgatcccatgttcatgatgatggccgcgccgatgaccagcaggaagatgaccggctcgaaccaggagtgggaggtgagcaggagaatcagaatcacgatggcgatcgcgaccagcatgatttggaccacctgcttcgaggtcgagacctcggtgtcggccgctgtggccacctcgccatccaggctgacctgcttggcgccggccttccaagcgacttggcggatggcgctggaggcgggcacagcgcgagccgcgtccacggtcagttggtaaaggtagccgtcgccccgcttccacggtttgaccacgcgcgcatcctggacttggacgggctctttattatcgacggcagaccccagccacatgacctgggtgaccccttcgacgtcggccaaatcccgcgacaggcggtcagcctggtaagggtccaggccctccgcgtagagccgcgcgttggggatgcccgaaccgaaagccgagcgcatgtctttgagcgccacgaccgaaggcgcttggctcggcaggtagtccaccatcgagtagttgactttcaccagcggataacagagggcgcacagggcggtaaagagggcgaaaacggccgcaacggccttacggtgccgcagaaaccgtttgcataaatccactgcccgcaacatccgcctcctcgcccccagtggcaacacagctccccggtaatcacgctagacgcttttttcgattcatgaaagccggcacgttcgctgcccgcgtaaggctgtccgctcccaatcgcgacgctccggcgcgctatgtcaagccatcgtgtacagtagtttcttgtcgctcgaccgcagctaagcgtgagagcacatggtggctatagctcagttggtagagcacctgattgtggttcaggaggtcgcgcgttcgagccgcgttagccaccccaccacaaaccccctactcccgcaacgggttagggggtttcgctttgcctattatccagcttcgggcaccaactcttgtgtgccatttgtgtgccataatttgcaaaaccatattcgcgcgcgcctaacttcgccgcacgtgctcacgccgcatcacccctgggtttcctgcgctgcggcagagggctggtcgggctgctccagctgcttgagcaggaggggttgggtcggttggaagaagtggccgtcggagcggaggatcaaggtgccgccaaggtggtcgaacaacagttggccttgatgctcgtcacagtcgaatgggtcatcaaacgagttgaagaggtagacctcgccggcatggtccttgatcctcctccagtcgtaagagtccttcaaggtcaggcatcggtttggtttaggcgtgcagtacccagcgagcagataggtggcgcgtacttgcacatccgcctgttccagtatggagaagatacgattggtgcccgccgaatgcccgatcagaatggtgccggcgtcgatccgcaagtccatggtacgagcagcgaacaacgtatcccccaaaggctccctgtccatcattggcaaatccgcaacgaccgcatccattccacgctcccccagctcaccagccagccaccaataccagtacctatcggcggaggcatacggcgtcgatccgtggaagattatggcattcacgccaagctcccttcagatgggttgaggtacgcacgcattaccaatagtagaacaaattttcgaacccatactggctgaagcctgtaagtagaatgataggaagcacaagcgcgcccgacccctgcgccgactggtcgcagcgagcgccacgcgccacgccaggcgctgccgaaaggactcaaaaatgctgaactttgtcaacgattattctgaaggggcctgccctgaggtgctgcagcgcctggtggagaccaacagggagcagctgcctggctacggcaaggaccggtacacgggctcggccgaggagaaaatcgcacgggcctgcggcaggccggacgcccaggtcttcttcatctccggcggcacgcagaccaaccagatcgtcatctcgaccatgctcaagcagtacgagggcgtggtggcggcctccaccggccatgtgaacgtgcacgaggccggcgcgatcgaggccagcgaccacaaggtcctcaccatcccccaggtggacggcaagctgccggccccgtccctgcgtgagtacctggagactttctgggcggacgccaaccacgagcagatggtcttccccggcatggtctacatctcctggcccaccgaatacggcacgctgtactccaaggcggagctgaccgaattgagcgacgtctgccacgagtaccgcatccccctctacatcgacggcgcccggatgggctatggtctggtggcgcccggagcggacgtgacgctggaggacatcgccgacctggccgacgtcttctacatcggcggcaccaaggttggggccctgtgcggcgaggcggtggtcttcccccaggccaacgcgcccgagtacttccaaaccatgatgaagcgccggggagggctgctggccaagggccgcctgctgggcgtccagttcgacgccctcttcaccgacggcctctacacccgcatctcccaccaggccatcgacacggccgagatcatccgccaggctttgcgcagcaagggttacgagctctataacgcctcccccaccaaccagacgttcgtggtcttggaaaactccaagatggaggagctcaggcaccaggtcaatttcgacttctgggagcgccgtgacgccaaccacacggtcatacgcttcgccacctcctgggccaccaagaccgaagacgcccaagccctggccgctctcctgtaaccctccaccaccggcgacgcgccaccagcccagcagccggcacaatccggcaaacgcctaatcgctggcctcggacgcggtcacgcttggatgcagctggtcaggcaggcggatggatacgctgaagacgccaggctgggtctcgacctccatcctaccgcccacggtggccgccaggtcccgcacgatgctcagacccaggccggaactgtcctcgcgcaagcgcccagcttccgcggtcccgaaccgcttcagcagctggttggcgccgacatagggctgctcgctctcgttcgtcatgcgcagcaggatgcacccgtccccctgccggcgcaggctcacactggcggtcctgaccgcgtacttgagccagttgccgatcaggttctgcatgatgcggtggagaagggtctcgtcgctggtgagcctgagcccaggttcgatgtcgggctccaccacgaccccccgcccggtcaggtggtcgaaggcggcgaacaggtcctcctgcaccagcgaggacaaatccacccggctcaggctcagaccctcgctcttctcctggatcaggttgaagtccatcaaataatgcaggtaatagtccaccgaatccaggctcgacgatgccttatggcagacatccgcgacagccgccatgccagggcccgggcctgcgttcccacctgcgccggcggatgcgcccacgctgcgctcgccaagcagctgcacgtagccccgggccacggtcaacggggtcttgatgtcgtgggtcaggttggtcagcatacggcggatgcgcaactcctggttgaaacgctggtcgtgcagcctgcgggtctgggccaggttcgcgttcaccgcccccaccagccgccgggtcagcccaaaccccgtgttggcggtgactgtggcgttggtcgcggcgccattgatgtactccaaatcccgcacaatcctgcgcaggtcgccgacgagcagccccagagcgaccgccagggcgacgatgatgaccccagcgaacgccagcagcatagcctcaatcaccgtgcgcctccccgctcccggagccgaccgaagccgatgccctctccccctccaggcgaccagcgcatcggatcgaacgcaccatgcgggcaaaagtcctcagacaaggcgcacccctatcccccaaaccgagacgacgaacctcgggcggcccgcggcctcgttcagcttggtgcgcaggttgcttaggtgcacgttgagcgtgttctccgcattgatatacgaccgctcccaaacagcctcgtacaggctggccttgtcgaagacctggtggggccgcttaatcatcaaggccagcagggcgaactccttcttcggcaggggcacgggcgaatcccccaggttgacctggtgggcgtccaagtccagggtgaggtcctcgaacgacaggcaccgcccctcccgctgccccggatcggacctgccgcgcagctggacctcgacccgcgcccgcagctcgtcgatgtcgaaaggcttggtcaggtaatcgttggcgcccttatggagcagggccacggtccggctcttgtcttgcacggcggtcaggacgatgaccggcaccgcggacaccttacgaatccagcccaggacgctttcgccggtcacaccgggcagcatcaggtccaggagcaccaggtccggctcgttctcgctgaacttggctatggcctccggcccgctcagggcttgggagagctcatagtcggcgcccagcacgtccgccagaagattttggatgtcccggtgatcctccacgaccagaatcctcgtcatcggggccttccttccgctcgtatgggactcacgggcattctaacccgccggatggagggtggcgaaactttagctttccttaatgctttcttagccaagcgcttgaggaaccgcccctagtctggtcccataggccaagagagaggacaacgcatgacgcagacagcgctcgacatccacgacgtgggcaagaagttcggtcggttcacggccctggaccacgtcagcctgagcgtccgcaggggcgacgtttacgggctcatcggcgagaacggcgcaggcaagaccacgctgatgcggctgatttgcggcctgagccccatgcaatccggctcaatcagccttttcggggagagcggcggggccagccgacgcgccctgagccggattggcgccgtcatcgaaagcccggccgcattcagctccctgaccgtggacgaaaacctcaaagtcgccgccatccagcacggcctgcccggctcggcggacatcaacgaggccattgaattcgtagggttgggcgaaaaacggagaaccaaagccaagcacctctccctaggtcagcgtcagcggctgggtttggccatggccatcctccaccaccctgatttcctgattcttgacgagcccatcaacgggctggacccctcgggcatcatggaatttcgccggctcttgcagcggctgaacgaagagcggcagaccaccatccttatttccagccacatcctcagcgagctctaccaggtctccacccgcttcggcatcatccacaagggccgtatggtcaaggaaatcagccgctctgaactggacgaagccaaccaggccggtctcctcgtcagcgtggacaaggcgcccctggcggcgcggattctagacacggcaggcatcggccccttcgaagtgagcgacgaccaccacctgttcatccgctcggacggggccgacccgggccgcatcaacctcatgctggtgcaggggggcgtcatggtcgaaggattcagccggcgggaggggtctttggagcagtattacctgaacctcctggccaagcagcggcaggcggacaaggaaggagcgcaatgatgatcaaccagatgagagcggacttttaccggcagacgcgcacaatcggctgctacgcgctgttggccctgaccattgggctcagcctcctgctgaccctgacccagcaggtgggcggcatgatggtctcggatgaatccagcgcccagcagatggagcagatcacccattcccactggtcggcgctgaccagcgtcaaagcgctgaccatgtccacctctgtcctgctctacgcctacatcgccctcttcgtgatcgtcatcggctacgagttctcccagaagacctacaagaacaccttgatctccggcatctcccgcctgcagttcatcggggccaagtacacggtcatgctcgtcgacatgctctgcctgaccctggtctactacttgaccggtctggtcgccagcctggcggccggtcgcggcctgggcgagggcgctgggagactggccggcgacatggcggtcgtgaccgttgccgtcgtcttcttcatctcggttatcttcagcctggggatcatcctcctggtggcaacaggctcgacgatcatcccggccatcgtgatcgtcgcctggccgctggccgtcgccatgctgacggaattcgcccactggacctggctcaagtatgttgatttcgtcacggtcgccacgaacgtggctttgtccaccattaagataggggatttgtggccctacatcggtgtgtcggtgggagtgcttgccttcacgatcatgggctcggccttgattatccgcgataaggagctgtgacggcctggccctgcaaactgcgggagccgcgaggcgccgcttatgcgacgggcgggtgccgaccccggcagcgtccggcgcccgccctcatccttcagcggcacggtaacgcttattactcggcctgcctccgagccgcatactcccccaagacctgcggcgtaatcccggcgtacgagtcgaaggaagcgaactggggaccatcgggcgcgcctccagggctggcgccagtgaaggccagggtggtcgcaccggacgcagcggccgaattcagcccggtgatggagtcttccaaggccacgcactccgccatccgccccgggtcaatgcccaccacctcggcggcgtgcaggtagggggctgggtcgggcttcatgggcagaccgtcatccccgcaggtgaagccaacgaaagcgccagccggcgcctgcgcgacgaccgcttcggctatgcgtcggggcgaggaggtgaccaggaccgagggcacgccagccgcggccagggccttcaacacatcaaccgccccgtctatccaaggcatccgctcgcgctcgcgccgggcgacgccttcttcgataagggcctgaatgcgcgggaccggtaaatccacaccccgctcgcgcatggcctccgccacctggacgacgggcttgcccgagcaccgccagccgtcctcctcgctccagtcaccgccgtgctcccgggccagctcctgctcgctggcgtgccagtacggctccgaatcaatcaaagtgccgtccatgtcccaaaagacggctttgggtaagggggcctgctctcgctgctgttcgctcatatcctccatggtaaaggcctctctggtccgaaactagggcccgtcataatgagttgttgtagatctggtcttgcagctccttgcgggcggcctcgaactgggtgattcgtccaagcagctcaaacttctcctgcccgtccggtagttggttcatccggtgcttactggccgcgatccggcgcatgtagccagcgtccaggagccgcaccagcagctcggtcgcgtattgcttctcctccggggtggcggcgcgcagctgggccgcagccgggttgggagccggttggccctcctgcctgcccggccccggggcgccttggccggattggtcgccacgggcgccgaaacctccagaaggcgccggttcctggccctcagcctggggcagaggcaggggcatgaccgccagttcgttgatcgcggactggagcatggggccggcggccttggacaggttgtgcatccataggccctggggcacatcctcccctggcagtccgcccgccgcctggatggcgtggtagagggaacggaagaggggcacgtcgaagtcgtcgtcacccagcttgtcgaagaaagccgggtcgatcgcgcggggaatctggatgagcaggcccatgaactgctgctcgcagatgaagaccgaatcgtccacccggtagtagtcctgcctggccgcgtcgccgctgaccagggcatggcgggccgtcgggtcagcgtaggggtccggcttgggccggtgacggagatcctcctgatagttgcggcggccgggggcgtaggcgtcctcgtcacgcacttgcagggtccggcgggcctggcggacctcgcgggtgagcaggtccaggtccacgcctatgcgacgggcggtcttacgggtgtacatgccgaccagggagcggtctcgaatctgggcgatgaccggggcgacggccttaaccgcccccatctgcccggtcgtgtactgggtgtcgaacatgctgaccgccgcgttgatcacgaaatcgtacaagggagtggcgttcgccaccagggcgcgcacctcctcgtcgccatgcttgatgcgcaggtcgcaggggtccaggttgtcgcgggctacggccacgaaggtctgggtcaggaatgagccgtccaggctgaaggcgtgcaaggcggccttctgcccggccgcgtccccgtcgaaagtgaagatgacgcgggagccttggatcgggccgaccaactggatgcctccgagcgcatcatcggaaatcagcctgcggatgatcttggcgtgctcctcaccgaaggccgtgccgcatgtcgcgactgcggtgtccactccggccaggtggcacgccatcacgtccgtatagccctcgacgatgaccacctggcgcttcttggcaatggactttttagccaggtcgatcccgtagagcacctggttcttgtggtagagctcggtgtcaggcgtgttcaagtatttggccgatatgttgtcgtcttcgtacaggcggcgggcgccgaagcccagggtgcggccagccgagtcgcggatgggccaggtggcgcggccgcgcaggtagtcgtagacccctcgcgggccccgccgggccaagccggcgtcgatcatctcctgctgggtgaagcccttagcggccaagtgacgaaccaggttgtcccaaccgcgcggggcgtagccacagccgaaacgggcgctgtcagcctgggagaagttgcggccggccaggagttttcgggcggccagggcctccttagtcatgatctgggagacgaagtagcgctgggcctcctcgttggcctgcaggaggcgggagcgggtcgagccctggtggctggaggggcgggcgttctcgtagtgcagttcaatccggtacttgtcggccaggatctcgatcgcgtcgccgaactgcacgtcttcggtctgctcgatgtagtcgaaaacgtcgccgcccaggccgcagccgaagcaatgccagacgccaagggagggccgcactgagaaggagggtgttttctcgttgtggaaggggcacaaacccatgtaggttcccgaccccgaggctttcagggtcacggtcgccgatacgatctcgtaaaggtccgcgctggcgcgcaccttctcaatgtcttccttcttgatgataccggccatacgctccagcctacctgcgagcgcggaagagcgttccaccgagcgaggaaggtccgctccttaagcgcaaaccagggagtggagggccagtgcggagccgtcggtcagggaggctacctggtcgatggccacgcgcaggcgctcgtcgtcgttagtggcttggacccagtcctccaggaaggagttctccagggcatccgaagggcggggtgagtcggccatcatcacatccaccaggtcggtgacgatccgccgctgctcctcgtcaatgggcaagcgctcacgaggggccatgacgaagtagaccgagatgcccttgagggccacgatctcgtatgaggtggactcgggaatgacgaccgtggccgagtaccgggtcaacggacccggtccatagcgctcgcgggtggcgcgctccaccgaactggcgaaacgcccgatcagccaggaggtcaggttcttgagctgtgccagggcccgcctggagccgttgaaatggatgggaagcttggttttgagccgttccagagccaccagcagcaggtcagggtcccactgagtgccgtaccaggagcgggccgattcgaccactccgtccataacgcgcgggtcagccagggccagcggattgaaggagccgccgacgatcgcgtcttccacgtcgtgtaccgagtaggcgatatcgtccgacaaatccatcacctggcactccatcggcgtgacgcccaggggcgcgccctgcttgagccagcggaagacatcctcgtcgtccggataaacgcagtatttgaggctccgctcccctttggggtgttgggaggcctcggctagggtccaggggtacttgaccgccgcgtccagggcggccctagtgaggttgacgccggccggccgaccatctggatggaagatcttggactccagacgggtcagcaggcgcatggtctgcgcattgccctcgaaccccccgatcgatttggcaatctgggccagggcgcgctccccgttgtggccgaaaggtggatgacccaaatcatgagctaagcaagcgcagtccaccacgtcaggatcgcagcccagcatctcgccgatttgccggcctatctgggccacttccagcgtgtgggtcagccgcgtgcgggcgaaatcgtcggaaccggccaccaaaatctgcgtcttggcgcccagcctgcgcagggccgaggaatgaaccagacgggccctgtcgcgctcgaaggctgtgcgggtctgtgatttaggcggctcaggggcccagcgctcctcgtcttgggcgctatagccttcagcgaccagcacctgctcgccgtcctcggtggtaatcatcgacacgcctcctgcgactcaggcccctccagcgccacagctccgccatggcttttactccagcttagcggcgacgggccggcgggtcagtccagcgagtcaacaacgaccagctcagtgggcacgttgccctgggtggccttggagtaggggcacagctgttgcgtgcggtccaccaggcgctcagccaggtcgcggtccactcctggtaggttgacttcgatcttggccttgatgccgaaggactcgccctcatcgccaaatgaaatcgagactctgaccttgctgcgtgccagcttggtggccgccacccgcagctccttgccagccaggcccatagcgccctggaagcaggcgccccagccgattgcgaagagctgctcggggttggtgccctggcccttgccgcccatggccaccggggtgtccaggtcgagggaaaggtcgggctcgtggctttcggcgtggccgttgcggccgccgaccacctcggcgacggcggtgtaggagatggtgcttagttctttacctgtatatgtgctcatatccttcagtccaccacctttcgaccttgaatgcaaggggtcggcggccgattacgccagcaggcgctaagcgcgcctccgggctccaagcgttcacaggagggcgcgcgggtccagcaggcgcaggtcctcggctggcagggcttgggccgcgtgcaggtagaggcggggaatgcgattgcgcaggcaggtgaaaatctcgtagctgatcgtgtccgcgctgcgcgcccagtcgtcggcggtgggctcgacctgggcctcaccgcggcccggaccgaacaagacgaccgtgtcgccctcggccacgcccaagtctcgggcccgggatcgcaggtcgagcacgcactggtccatgcagacgcggccactgacgcgcgccaatctgggcccctgcttggtcatcaggcgcaccggaccgcccaggtgctcacggcccatagcaccggagcggtcgaagccggaggcggagcggtggatgccgtccgcgtaacccaggggcaggatggcggtggaagtggcgccctgcgtcaggtaggtgcgcccgtaggaaatgccgtggccggctggcaggtccttgaccgtgcccagctgggcctggagggtcatagccggctggagctggtagtcaccggggacgcccatcgaggggtcgggctcatagccgtagaagccgatgccgggccgggtcagctcgtagtggatctcaggccgggacagggtggcggccgtgttcgccagatggcgcacccggggctccagaccggcggcccgcatccgatcgtcgaagtcctcgaaagccttgacctgagcatcggtggaagcgacgaagcctggtacattcggcatgtcggccacggccaggtggctccacaggcccacaacctccagctcgcccctgccagcatgcgtcttcagggcggtcagagcctcgtcgaaccggtcgggggcgaagccgttgcgaccgaaaccggtatcgacctccacgtggacgcgggcgggacgacccagctcttcggccgctttagccacctgcgcgataccggtcaaggagcccaccgagatgtcgatgtcgtgcgcaatcaactcgcccaggggggctgtggtcccgttgtacatgagcaccagaatccggcagcgctcgggcccgatgcccgcgcgacgcaccagcagcgcctcccggggctgggctgatcccagccaggtggctcctcccgccaaggccgccaaggccgagggaatgagcccgtgcccataagcgtcggccttgatcacgcccatgacttgagcgcccgaacctgaagcggagacccagctgaccagcttggccatgttcgccttgagggcggagaggtccacgatggcctgccctgggtaggctttcagagcccgctgatagttctccctgccttcttcggatgaaaaatcccactggggcgccgcgttcaaactcatggttttcattgtgcgacaagcgagtcgctgacatgccgccggcccctagaccgtgacgataccggcacgtttggccccgatcagacctgcgcgcctggcctatcgtggcgctggtaggctatgcgcgtgtgctccgtgctcgggtcgcggctgtcatgcatggtgatcaggccgcagcgggtgaaaccgttggattccaggatgtgctgcatggcgtggttctggagcccggtgtccacacgcacgttgctgtggtgacgcatgcaccaggagagaatgtcggccgcgacgcccttggcctctcctgaggaggccacccggtggacggtcatgtaagggtcgtcatcgagccaactgccctcaatctgcccgtaggcagggtccacaccgtcgaacagggcgaagacgccgatcacgcgctcatgctcgccccggcgttcctccaactcggggcgctcgaccgacgctcccggcgccgcctgagcgccgtccgccatgtcgtcgaccagaagcatggcgtgcctgcccgagatgtcgccgctgatcgtgtccggatagggatacttggccccccactgattagggttgccagcctcaaccatagcctgacgggcccgggcgaagacggattcgatcgacgcggtatcatccatgccggcgtgacgcagccaacgctgcgcggggttgaaaacctgcaaggggcacctctttcttaatcgtagagtcctgccggcgccgcccgtcccttgtggtcggcccgcgccgaacataaaagtctagtgaccgtcatggcctgccggtgcccgtccgcagtaagcgaaccggggaataaatcccggtgatcgcacctaggatgcccccagagtatgcgaaaggcgggcgccctggctcgcaggggcgcccgcctagcgcaagagcctcagaccaccttgcgctcaaaggggtcggaggagatgccggcatccacgatgtcgcggcaccattgcttggccgagaagagcgagtggtctcggtagttgccgcaagaggtgatctcggtacccggcacgtcctcccaagtggcctccgatgctatgaattccagggactccttcagggccttggccacgtcctcggtggagtggcggccccaggccagcagatggaaaccggtgcggcagccgaaaggcgagcagtcgatgtaaccggggatgcgctcgcgcagcaaaacagcgatcgtgtgctcgattgtgtgaagtccagcggtgggaatcgcgtgctcattaggctgaaccagacgcaggtcgtagttggagatgacatcgcccttgggcccctcctcctcgtcgattaggcgcacgtaaggcgcctttaccttggtatgatccagctggaagctctcaactaccggtttctctgccatgatgcagtcctttccgtgcatgttctcatcttcgttcccgccggcgccacctgctcgccgggttccctaactccatactaagcacgcgccccgccagccctggacccacgcccggtcctgcgccgcccgcgagcccgcgaaaccgtcaggagaactcgcggagggcttgcaggaattgctgtccgtagagctccagcttgtgctcgcctacgccggtgacctccaggaaggcctcctcgctaaccgggcgacgcctgcacatgtcgcgcagggtcttgtcggagaagacgatgtagggcggcttgccgatttcgcgggctatccgcgtgcgcacctggcgcagggcctggaagagacgcccctcctcctcgctaggctccggttccccttcggccagcgcggtcgtgcggccgtacactgcgccggacgctctggccgcgcccttgggctcggcccggcgcacctgcttgatctcgtagtggaagtccgggctcacggtctcgccggccttggggccgaactggaccaggggcaggcggccttcggtgatggtcaggtaaccgtccgaggccatctggttgagcacgtctcggatgcgggccgcgcccacgttttccaaggcgccgtaggaggggcagcggtccagcccccggctgagcaggtcctgggacttggaacctgccaggacctgcacgattttgcctgagccgaagcgctggcccacgtcgtgcacgcaacgggagatggcacgagccaggtcggacacgtccacggtggagaaggtggacaggcagttggagcagttgccgcagccgcttttggcctgctcgtccgcctggctgttgacctgcgccgcggctccattttccatctcctcaccgaagtagcggagcatgtaggcgtgcaggcaatcggtggtgcggcagtagccaatcatggtgttgagcagacgtcggcggctggctcgcactacctcggcctcctcgccggtgagctggtcgttgcctgaatccatgtcgagcaggcgacggcgggtcacgatgtccgcctcgttccacaagagggtgcagcgggccggctccccgtctcgcccggcgcggccggcctcctggtagtaggcctcgatcgactcgggcatgttgtggtgaatcacatagcgcacattggacttgtcgatgcccatgccgaaggcgttggtggccaccacgacttgcacttcgtcgttgacgaacgcggcctgtgcgtcgtctcgggcggccggcgccatgccgccgtggtagctggcggcaggaattccggcttgattcagctctgcggccagggcctcggtctccttgcgggtggcgcagtagacgatgcctgactcttggccgtgctccttggcgtaggaggtcacccaacggtccttggccttggtctccagcttgaccacgtcgaagaagaggttggggcggtcgaagccggtcaccgcctggtaggggtcgcgcaagtccagcatggagacgatgtcgcgccgcacccgttcggtggcggtcgcggtgaaagccgccacgcggggccggacgggcaggctggctataaagtcgccgatgcccaagtacgcaggccgaaaatcctgcccccactgggagacgcaatgggcttcgtcgaccgccagcaggtcgattctggcctgggccgcgaaggcgacgaaccgtggtgcgttgagccgctcgggcgccacgtacaggagcttgcagcggccctgggcggcctgggcgagcgcctgcgcctgctcgtccggggtctgtgtggagttgacgaaatgggcgtggatgccagcgtcctccaacccgtccacctggtcacgcatcagcgagaccagcggcgagacgacgatcgtgatgccatccaacagggtggcgggaatctgatagcagatggactttccggcgccggtgggcatgacgcccaggcagtcacggccttccagaatcgccttgaccatgcccgcttggcccggtcggaaggactcgtagccaaaatactgcttgagcgcagcgagagcctgatccatgtctgtcatacttcacgagtctatgaccctaaccacccaggcgcgcccccagtccgcgatgtgcgcaaccatgggtcccaggcgcgcctgtggacaagtcgcattcacaaggggccgaagggcgcgcgattctcaagaggccgaacctgaggagccgggtgcggaggcggcggcgatcagctccctcgtgtaggcgcatccgggctgggacagcacccggtcggcgggcccctcctcttcgacctggccctggtggaggaccacgatgcggtcggccatatgctggaccacgcccaagtcgtgcgagaccatcaggatggccgtccgtggccggcgggcgcggaccgtcttgaaggcctccagaacgcccagacgtgcggagacgtccagggaggacatgggttcgtcggccacgatcagctgggggtcggccaccagggcgcgggctatggctatgcgctgggcttgtccgcccgagcagtccgctggatagcgcccggcgaattcacccggatccaggccggcgtccgccaaagcctgcatggccctgctgcggatcgccgcccggcccaagcccagctcacgggcgtggatgcgcagaggttcgctgaccgagcgcagggcgttccaccgtgggtcgagggaggcgaaggggttctggaagatcagccccgactcccgccgcaacgcctggtagccgctgctgcgtgggccgtccaccggttggccctggtaggacacgctcccggcatcgcggctttcaagccctagcaggatgcgggtcagcgtggatttgcccgagcctgagcctccgaccaaggccaggcactccccttgccccaggctgaccgatacctcttgcaaagcttggctgccgccctgccgaccgccgaaggttttacggatgccttggccggatatgacgatccgccgctcatggcccgtgccttgactcatggcctgcctcctcgcccggcgctgaaccgcacggccatgtccgcgtctgcgcctgagttcccgcccgcgccaaagcctccatccactcccccgagaactgggtccaagctcaattgcgcggcggcccggaccaggctgcgggtgcgttcggcttgcggatgtgccagcagtctgctggtaggaccgtgctcgacgacctgcccctggtcgagcacgtaggaggtccggcaggcgcgcgccagcacggagaaatcgtgggtgacaaagagcatggaggccccgctggagtccaccaggcgaatcagcaagtcgataatcgcgcgctgggtgatcgcatccaaggcggtcgtaggctcgtcggccacaatcagcctaggggcggtgaccagggccgtggcgatggccacccgctggagctgaccgccggagagctggctggggtacttgcccgctatttcagggcccaaacccacccgttccagcatgtcttggaccctctgcgcccgctcggcacggctcagccgatagtgcaagcgcaggggcagggccacctgctgggcgacggacaggacagggttgagcgaggctgtgggattctggaaaaccgcgcctatgtatgcgccgcgaaccccagccaggccctcgtcgctggcgcccagaagctccgcgccacgtaagcgaatcgagcctgagacctgggctcccggaggcaggatgcccaggagggctttcgtgatcatcgatttgcctgaaccggacgggccgatcagccccacccgctcgccatcggccacgctcaggctggcctggcgcacgattggacggcccccgatcgagatggtcaggtcttctatgctcaggctcatgcctcccccttccgcaggacggggttggcagcggggtctatggcctcgcgcaggacatcgccgaaaacgttcagggcgacgactaccagcgtgaccaccagccccggccacaggaccgtcaacgggtagacgttgatgaacttgaccgaggtggtcagcgaatgcccccaggagggcacccccgagggcacgccgacccccaggtaggtgaggccggattcagccaagacggacgtgccggcggacaaggagagctggacggccatcggaggagcgacgttgggcaggatgtggctggtcagaatccgccagccggaagcgccggacgccagggccgactgaacgtagtccgaaccagcggccagcagggcttgagggcgggcgacccgggccaggttgagcccgtaacccaccccgcaggcgacgatgatgaccgccacggaagctcccattggcacagccaggagcagggcgagcaggacggtggggattgagatcagagcgtcgaccagcacaatcgagccggacgacaggaccttggaacggctgaccgtagcggccaggagcagggtgcccaaggccccggcgaagacgacggccaggaggcagatcaacaggttggtcgcggacccggccaggagccaggacagcacgtccgccccagtgccgtcggtgcccagccagtgggcccgggagggggactgccagacctgatagccgtcagtgcgccacagaggccagggggtccaaaccaggcagaccagggccgtcaggacccataagcccagcgtgaccagggcgaaacgcccctccctccggttccacatgctggcgatcaccgtgcgcaaccagcgccaggggcgggctgaccggaccgcgtgccccgagctcccaggaccgggctccgccgtccaagccgcttgttcatccatcatcagaccccctccccaatcgaattagccgctttcaggcgcgggtccagggcccggtggaggaggtcgacgaccaggccgaccgccaggaagaaggccgccagcatgaacaactcgctctgcaccgcgatcaggtcgcggttgcccaggtcggtgaccaagccggaacccagccccggcagggcgaacaggttctccaccaccatcgcgccggtgatcatctccgcgaaggtcagcccgacgaccgagaccagctggggcatggccaggcgcagtcccacccggatcagggcctgggagcgggtcatgccgcaggccatggccatgtcgatccaaccggacgaagccagctcggacaatgcggcacgggtgtaacgcatgagcccagcgcccacgatgatccccagggtcagggccggtaatatcaaggattgaaacgcctgcgcgccggaacgccagcccgcctcggggaagccttgcgaaggcaggatgggcagcagcccgctgccccgcccgaacagcacgatcagcagcagcccgccccacagagcaggtatggagccgcccacgatggcgacgacctgacacaaggcgcgcgcacgggggctgcgggccagcagtgagtagcagccgagcggtatgcctatgcacagggcgaccgccagccccaacccaatcagagggaaggtcaaagcggcccgggaggccacctggctggagatggagcggccggtcagcatggacaccccgaagtcgccgcgcaggaggccgcccatccacgaggcgtactgctggggcagcggccggtccaggcccagctgcgagcgcagggccgttacccgctcgggcggcgagttgattccagccatgatggaggccacgtccccgggcaggatgcgcagggccgcgaacaccaggagggagagcgccagcagggccacggcgaaaagcaggagccggcgaagcaggaatcgcatggccttcccctaacgtgccgccagagcggaagagccgctggctgcggcgcctcccggcgtgtagtagaccccagccaggggcaggagggtctggttcaagttcaggggcaggccgtgcagcccgacggcccaagcggtggtaatccggtagttgaagagccaatcggccggcgcgtcctggctgaccacgcgggcggcctgggccaggtagcgcccgctctcctgctcgttgggctcggccatagcctgccggtagagctcctggactctcggattgtcgtagccgtagtagtacttggggttggcccactggttgaagtcatggctctcggagtggtccaccagggagatgtcgtagtcgcggttggtgtacacgtcctgcatccaggtggagaactcaaccacttgcacgttcaggtcgatgccgacgggcttgagttgggagcgcagctggtcgcccagctcgctgccgtaggtgttggcgtaggtcagccgcagtttcaggggccgctgcgggctgtagccgacctgggccatgagctcgcgcgccttgcctgggtcatgcgggtaaaggccggtcagatcctggtagcccgggtccaggatgggaatcggcccgcccagcgctgtgtcggccccgccccgtgcgacgatcagctggcggtggtctatggcgtaccggatggcctggcggacgcgcggatcgctggttttggcgcccttggagttgaaggccaggacgaacttgtccgtgccatccccagcctgcacctggtagtggtccgggtccttcctgaagggctcggccaacgtggcggtgattggagccagggcttgcacgtcgttggatttgagcgcattgaccgccgcgttgtcgtccgcgaagtagcgcaggcgcacggtctgtgtccgggctttgcgctcgccccagtagcgggggttggcgctcagggtcagcgaggaggaaggtttgaaggatgagactgtgtagggaccggagcccagggcttggctcttggggtcatagtaagcgcgcctgtcgaagaccaggccgggtcgtccggtgagcgcccagagcaggcccgcgtagggggcggtcagcttgagctccacggtgctcgggttcagcgccttgaccgattggaagttgcgcagctggtcggcgtcatggtagccgcgttggaccagctcgttgattgaccaggccacatcctccgcgtccagccggtccccgttggagaaggccatcgcctcgtgcaggcggaaggtgtaggtggtgccatccgcgctccggctccagctcttggccagtccgggcgtgacttggttgtggtcgccgcgggccacgagcccctcgtacacgttgccgaccagggcctggtccagggctgagccggattggttgcggatgtccagattggtcggcgccagtttgaggccaatggagattgagtccgccgtccgctcggccgcgccgccccccctgcttcgtccgcctacccacagcgaaacgaccagggcgaccgccagcagcaggctcagcggcttccatccccagcccgaatgcgcgcgggcgggtttgagcatggcattgagcaccgggtcggtgctgggtccaggcccggcatccggggtcgcgccgtcgcttgcgtgcgcgccctcctgggaagagttcatcgcgttaccaccttgtgtctggttggccgccataggggtcgaccaccgtccaccagtctaggacaccgcccgcccggtggcgcgcagggccgtagaatgaagcaggaaagcgctcgtagcgagacagcgaggaggtcggcatgctgctggcggtcgacattggcaacaccaacaccgtgattggtttcatggagggccggcgggtccgcgcctcctaccgcatcgccaccagggcgggccgcaccgctgatgagtatggcatgattttgaccgatttcctccgcctgtcgagctacgagccagcggacatggagggcgtcatcatcgcctcggtggtccccaaagtcatgcactccctgcccgccgccatcgtccgctacctgtcggtggagccgctggtggtgggccccggcgttaagaccggcgtcaacatccgcctggacgaccccaagtccctgggcgcggactgcctggccgactgcgtgggcgcgcatgagagttacgaaggcccgctcctggtggccgatttcggcacggccaccaccttcaactatgtggacgcccagggctccatccgctccggcctgattaccgtgggcatcgactcgggcgccaaggccctgtggtcgcagaccgcccagctgcccgaggtggagctcacccgccccagctccatcctgaccaccggcaccagggatgccatgcaggcaggcctctactacaacttcctaggcggcctggagcgcatcatcctccagttccgccgcgagatcgacaacgatttccaagtgatcgccaccggcggcctgggccgcatcttcgcttccgaaaccgacctcatcgaccactacgaccccgagctcatcttccgaggcatggccaccatctacagccgcaccatgcaggccgcccccaccgcgaaataggacggcggcgcaagacggggcaaggcgggcggatgatacggaaaccgcgaagttgcgccagcagcaatcagacagcctagcctcctccttcactcacatccgagccggtcttcgccgccttatggcctttcccattcccccctggtccatagtcacccgcactagcatgaatacacctccgacgtagccaaccgaatccgcctcatcctaggagaggtgcgcgcttgctgctggcggtgctagactcagtaactataacatgggggttcgcggccctgaactggctggagagttttgttctgccgcgcaccacccgaataccaacaacacactgttttcacggaagagcgcgcatctgtgcgctcttccgccagcctgttttggagggggcaatgagtcgtttccgcgccgccagcgccgcattcgcggccctggccatgatcctcctgggggggggggtaattcggcggcccgtcccgcccacgctgaacccaaccacctgacccgatcgggagcccccgcctcgcagaccgtggacggcttcaccctgtcccccaccaaaggccccgccaaccaagacgccatggccacgctgacaccaccagccccgccaaccaacgtgcgcttcacccgaatcagcgcaggctggtggcacagcctggccatcggctcggacggcaacgcctacgcctggggagacaacgactccggccagctgggcgacgaaaccggtagcggcagccgcagcggcaaaccggtgcgcgtgcacgcgccaaccggcgtgaccttcacccaaatcagcgcaggcgacgatcacagcctggccatcgactcgaacggcaacacctacgcctggggatacaacgcgttcggccagctgggcaacgaaaccggtagcgacagcaacaaaccggtgcgcgtgcacacaccaaccggcgtgagcttcacccaaatcagcgcaggccactggcacagcctggccatcggctccgacggcaacacctacgcatggggaaacaacgcgttcggccagctgggcgacgaaacccctagcgacagcaacaaaccggtgcgcgtgcacgcgccaaccggcgtgaccttcacccaaatcagcgcaggcgacaaccacagcctggccatcggctccgacggcaacacctacgcctgggggcgcaacacctccggccagctgggcgacgaaaccggtagcaacagcaacaaaccggtgcgcgtgcacacgccaaccggcgtgaccttcacccaaatcagcgcaggcgacgatcacagcctggccatcggctccgacggcaacacctacgcctggggagacaacgactccggcaagctgggcgacgaaaccggtagcgacagcaacaaaccggtgcgcgtgcacgcgccaaccggcgtgaccttcacccaaatcagcgcaggaagctatcacagcctggccctcgactcgaacggcaacgcctacgcatggggatacaacggctacaaccagctgggcgacgaaaccggtagcaacagcaacaaaccggtgcgcgtgcacacgccaaccggcgtgcgcttcacccaaatcagcgcaggccactggcacagcctggccatcggatcggacggcaacacctatgcatggggaagcaactactccagccaactcggcaacggcagaagcgactacggcacccacagcaggcccgcgccggtgctcatgccccggtatgtgatcgacggcgtcacgttcgacggggcaagcgtcacccggaagaccgtcaaccccgccaccggcgcctgggacatgcacgtgcccacgcatgccccgggcgccgtcaccgtgaccgtcgcctaccatctcgacggcctcgacgtgaacggcaacatcgccaaccccagataccagtccggcacggtcaccctgcgttacacgtacgccaccccgtacaccgtcagcttccaactgggcggggcgccgggaaccccgcccgccagccagtactcgtacccggacgacccgcagcccatcaactggccggtccccgacccggtttgggcgggccactggttcgacgggtgggccaaacccgacggcagcccctgggacttcacccaacccgtcagaaacgacctgaccctgaccgccacatggaggaccccacggttcaccatgacccccacccggggcccggacaccggcggcaccaccgtccacatcacaccacccgacccgccccaacccctccgcttcacccaaatcagcgcgggcagcttccacagcctcgccatcggcaccgacggcaacacctacgcctggggacggaacgactacggcgagctcggcgacgacacccgcaccgaccgcaacacgcccgtgcgggtgcacacgccagccggcgtgcggttcaccagcgtcagcgcaggcaacgagttcagcctggccatcggcagcgacggccacgcctacagctggggatacaacggctccggccagctcggcaacgacacctccacctaccatagaacacccgagcaggtccacgcgcccaccaacggcgacaaccccgccaacacatggaaaaccatcagcgcaggctactggcacagcctggccatcggcagcgacggccacgcctacagctggggagccaacggctacggccagctcggcgacggcagcaacgacgtgagcgacaggcccgagcaggtccacgcgcccaccaacggcggcaaccccgccaacacatggaaaaccatcagcgcgggcgaccagttcagcctggccatcggcagcgacggccacgcctacagctggggagccaacgactacggccagctcggcaacggcaccaacaccaggagcaacaggcccgagcaggtccacgcgcccgacagcggcaaccccgccaacacatggaaaaccatcagcacaggcggctcacgcagcctggccatcggcagcgatgaccacgcctacagctggggagccaactactgtggccagctcggcaacggcagcagcgacgacaacccccacagcacgcccgagcaggtccacgcgcccaccaacggcgacaaccccgccaacacatggaaaaccatcagcgcaggcggcgatcacagcctggccatcggcagcgacggccacgcctacagctggggagccaacgactacggccagctcggcgacggcagcaacaccaggagcaacaggcccgagcaggtccacgcgcccaccaacggcggcaaccccgccaacacatggaaaaccatcagcgcaggcggctaccacagcctggccaccggcagcgacggccacgcctacagctggggatggaactggcacggcgagctcggcgacggcagcatctacggccgcagcacgcccgcgcttatagggcacaagatcaccgtcaccggcgccaccttcgagcccaccaacgcccccacacccacctggaaccccaccacccacacctgggacaccaccagcccaacccaccccgaaggacaagccaccgtcaccatccactggaccctcgacggcgtcacccaaaccgactaccccatcaacccctacgagtactaccacctctacaccctgcccaaagcaggcggcgcccccacccaacaactcgcgggagccaccctcctcaccctcaccaccctcaccgcactcaccctcaccagccaccacatcacccgcaaacaccaccacacccaccaacccaccacaaccagcaaataaccaaccaacccaaggcctgcggtgcggcccaccccaacccacccgggccgcaccttaaacacacgagcgccgcacgatacccctcgatcctaccgctccgcggcccgacactatccccagtagacaggccgccagtccgcaagcgctaggaaacggtcccagctcaaagacagagggggactcgtgattggaagcgcatgggttggccggttatgggatcggtgaaggagagggagcgggctaccagctggagggggtggctgaagtcatcgtaagggcggttgatgacgattgggtagaggtcgtcgcccaggataggcaagcccaggctggccatgtgcacgcgcagttggtgggtcttgccggtgtatgggtggagacggtatgcgcggtaaggggtggaggccctgccggtcgtcccctcccccggtaggcagccgccggacgagtcgagcgcgaaggttgggccggaggaagtagcgtttccgcgcccaccggcaaggttgaaggcgggaagctccccagccaggtcgatcaaggtggaggcattgggctgggcgcgcagctccctggcctgcatgtggccggggtgcttgtctatataggaacggcgcaggagggggaagggggccggtggggccaggcgggcgatggtgccggtggcgggcgtggtcagcgggcgggccggagccaggcattcatagactttgtcaacttgtctcctctggaagagcatctggtaggcggcccgtacggaggggtcgcgcacgaagaccagcactccggcggtggctcggtccaggcggtgggcgggggtgatttgcggctcgcccaaccgctcgcgtaggcgcatcagggccgagctgcggtaccacatgccgcgaggagtggtaggcagaaagtggggtttatccactactatgatccgctcgtcctcgtagagcacgcccaactcgaagggaatctcgggctcgctggtcacccaccggtgccgttcgaaaggaccagccatcacagcgccaccgtcatgtcgctagcgaaccgtcactcgacggtgaccgacttggccaggttgcgcggcttgtccacatccaagtccttggacttggccatgtcgagcgcgaacagttggaggggcaccacgtcgaccagagggctcaggagcgtggggcaggcggggcgccagaacaccacgtccgcgtactcctcggcgtccgggtccccctgttcggccacggcgatgacgaacgccccccgggccttgacctcctcgatggcggagacgaccttcttgtggagtgtgccgcggccacgggcggagggcacgatcacgacgatcggctcgccgggctcgaccaatgcgattggcccgtgtttgagctcgcccgccgcgaagccctcggtgaaggtgtaggcgatctccttgagcttgagcgcgccctccatggccaccgggtagcctacgtggcggcccaggaagaggaaggacttggcgtcgaccagactgcttgcggtccgctccacggtatcggcctgggtgtcaagcacccactcgatcttggagggcatggcgcgcaggctgtccacggtctggtggatttcgtcgcggaagagcgtgcccttgacctgcgccaggtacaggcccagcaggtaggcggccacaatctgggccacgaacgccttggtggaagccacagcgatctcaggaccggcgtgggtgtagagcacggcatcggattcgcgcgggatggtggagccttgcgtgttgcagatggcaagcacgcgcgagccctgctcgcgggcatggcgcaaggccatcagggtgtccatggtctctccggactgggagatggcgaccaccagcgtgcgcgaggtgaggatggggtctcggtagcggaactcgtgggccagctccacctccaccgggatgcgcacccagtgctcgatggcgtacttggcgaccattcctgcgtaggatgcggtgccgcaggccacgatgatgattttgtccacctggcggatgtcctcgggatcgatgcgcagctcgtccaggttcagttcgccttccgggccgaaacggcccagcagggtgtcggccacggccttgggatcctcgtgaatctccttatccatgtaggagtcccagccgcctttctgcgcggcggaggcgtcccagttgacggtgaagcgcttggagtccgtgacagggttgccgtcgaagtcggtgacttccactgcatcgccgctgacgcacacggcctgatcctggcccaattccatggcctctttggtgtaagccacgaaagcggccacgtccgatcccaggaagttctcgccctcgctcaaccccacgaccagcggggaatcgtgccgggcgccgacgacgatgccgggctggcggctatccacggccaggagggtgaaggcgccttccaacatgcgggcggtgcgacgcatggcctcgaacaggtcaggctggccggtgcgctcgatgatctcattggcgaccttgcccagcagcttggccaccacttcggagtcggtggaggagacgaacgagtaaccctcggtttgcaggtcgaacttgagttgggcggcgttctcgatgatcccgttgtggatcagcccgatcttgccgtcctggctcatatgcgggtgcgcgttcacatccgaaggctcgccgttcgtggcccagcgagtgtgaccgataccggccgtggcttcaggcagggggtgcgcttccaagctttcaactaaattgctgaggcgtccggcgcgcttgcgccaggccacggtgtccaaaccaggggccaccagggccacgccggctgaatcataaccccggtactccaagcgctccaaaccctgcaggcagacctccaatggcttaccgcaagcggttaacgtagatgaggcatatccaactattccacacatgactcaccagtctaggcccagggcggggccgttacgccctgggcgggtcttccctagcgctatgtccacatgaatccatcgatacgccccctgcccggcgccttaaagcacggtccgcaggaactcctggaagcgccggctctccgggtgatcgatgatgtcagggccgccgctttccaccacgacgccgccatccatgaagacgacctgcccggcgacctcccgggcgaagcctatctcgtgggtcacgacgaccatggtcatgccctcagccgccacctgcttgatgacagccagcacctccccgaccagctccgggtcaagggcagaggtgggttcatcaaagagcatgatctcaggatgcatggcaagggcacgggctatcgccacccgctgctgttggccgccggagagctgggaggggtagtagtccagccgatcgcccagacctacgcgctccagctgcttgatcgcctcctccttggcctgcgctttgggcacatgccccacgtggaccggagcctccatcacgttgcccagagccgtcatgtgcgggaagaggttgaaacgttggaagaccatgccgatgcgggcgcgctgtcgggcgatggccttatcgtccagacgttgcaagccctggccgtcggggccgatgcgcttgtagccggtcagctcgccgcctacgatgatctcgcccgcggtgcggtcctccaactggttgatcagacgcaagagggtggatttgcccgagccggaaggacccagaatggcggtgacggtgcccggcatgacttccaaatcaatgcctttgagcacgtgcaggtcgccgaaggccttgtgcacgccccggataatgatggccggctcctggccagtcgcctccttttccgcgttcgtatcagcgctcatgttcatttgcccgctcatgcgttcaaccccgccatcatcacttgattgaccttatccgtctcctgcttggccgccggatcgacggcctccttagcgtccgggcccttgcgcccggccaacggccgcgcgtcgaagcccttgccgtagtgcttctccaactgggcttggatgaccatcagcacggaggtgatcagcaggtaccagatgcaggccacgatcaggagcgggatggtcttgtagatgcggttggcgatcgcgttggtcgcgaactggagttcgagcgtgaacggcacggccagggccagagaggtggtcttgagcatgccgatggtctcgttgccggtgggcggcacgatgatgcgcatggcctggggcagaacgacccgccgcatgatcatcgaacggggcatgcccagggcttgggcggcctcggtctgcccggtgtcgaccgcctcgatgccagcgcgcacgatttcggagaggtaagcggcttcgttaagacccaggcctagcacggtggcgatcgtggcgttgagcacatcctgggtgttgaaggagaggaactccgggccgaaagggatgccgatggccagcctgggcaccagaaccgcgaacagtccccagaagaccagctgggtgtacacaggggtgccacggaagaaccagatgaagaaccaggacacccagcgcaggacagggttggccgacttacgcatgaccgccaggatcacggcaaggatggtggccaggaccatcgcgtagaccgtgagcaggagggtccacttgatcccatcgagcacgtgctcgttgaacaggtacttccagaccgtgggccagtcgaagttagggttggtcaccatcccgtggatcagcatggccacgaaaacggccacgatgaccgccgcgatgaccggtcccggcctcctgaccggcttggcgtggatcctccctggaatatccagcctgtcgcccttgtcccgtcccaacatgctcgctccttagcctcgcattcggatcaccgccgcacggacccgggcgggcccacccccaggcccgctcgaatccacgtggctcgaatcagtccgccacctcggggttgacctcggccttatccacggcaccggacttgacgccccagtggtccatgatcttgccgtaggtgccatcatcaatcagcttctgcatggctttttgcgtggcctccaccatctgcgtatcgcccttcttgagagcgatgccctgcacgaccacgtccgagtccttgcccagctgctccagattgcggccggtctgcttaatggcgtagccggtcacctgcgaatcggcgtagaacacgtcgatcttgccggtcatcaccgccgtggccgcgtcggtctgcaacttaaaggactgcacatcgatggccttcttgcctttggcggtgcattccttggagagcttgtccgcgccctgctcctccatcgtgcccgtctgcacgcccaccttggagccgcacaggtcgctgtcctggagtttcttgggattgcccttcttcaccgcgaaggcggtgccggctttgaaggatgtgacgaaatcgacggcctgctcccgctccttggtgatggtgaacgaggagatgccagcgtcgtacttggagccaatggaggggatgatcgaatcgaaggaggcggagaccatctcgggcttgagccccatctcctgagccagggccttggacaggtccacatcgtacccaatcggagtcttgccgtcctcgtccacgaattcccccggcgcgtaagtggtctccataccgaccttaaacttgccgtcaccggctacggactggggcaccagggaagcgatcgcgtcgtctttcttgatgccggacacgtcgtaaggcgtggggtgggagagagccgaggagtccttgccggaaccgccggacttggagggctcatcggtggtgccgcaggcgcccaggctggccaggagcgccaggctgatgaccgctgcccccaaggctttgattgacttcataatcgcgtcctttctctcgccgcggcgacgcctcggccttcatccactagtactattatgcatcaatttgtatttttatgcatcgtgccctagcgaaccttccacagcccacccgggcgagagccccaaaaccctggaaccgcaaaggaaccagcgcctggcggcgttcatcgcagcccggacctctccggcgtgtcgcggctatgtgaatcgctatgagcgaggagacggcgcatccattgccgccgtatgccatacgagcaggcagaccacgcgggtcaggcccgacccctaaggttcttgtagcgcatggcccgctgagcctcgcgtttgtcttgctcctcgcgcagagcctggcgcttgtcgtactcacgcttaccgcgcgccagggctatttgcaccttgacccgcccatccttgaaatacaggctcaaggggacgatcgtgtaacccttggcatcgatctgccggctcagcttggcgatctgcttagcgtggagcaggagcttacgcttgcgtttgggcgcatgattgttccaggtgccgttaaggtactcgggaatgttcgccccctccagccagacctcgccggagcggtcaatcgagacgaaggcctcagccaaggaggccctgccctcgcgtagggacttgacctcggtgccggtcaaagcgatgccggcctcgtactcgtcctcgattgtgtagtcgtgcctggcacggcggttttgggcgatcgtctgaatgcccgtctctttggccatgcgacccccttcccgcgcctctgccggatgcgctgctccttgtggaatggccttctcgaactggcttcgaccatagcacgagggcgccaccccggttgggatgacgccctcggctcagccaggcgtaccgcttaacttaataatgcacgtactggtaggcgccggcattgtagacgatctcggaggccgggaacgtggcgaatcccgtgccgccctcggagatgaggaccgacccgtcaccattcacacgctccaccaccgcgacatggccgtactggggatcagcgttccagctaccgacccgctggccttgggcgaagaccatggccgctcccacatgcggggtgttgttgaccacgtagcctaagccacgagccgtgttggcccaatccgcgccattacccatatacgagccgacgggcaggctcagctgagagcgccgcaggtaggcccacagggtgcactggcgggggggataggcggaaccacccacgctgttgcccgtggggtgcccgtagcagaagcccgagccggaggggcaggaaccggggacggcgtagttcatgccaaaggcgccaccgccaccgccgccaccaccaccaccgacggagggcgctgctccgccgccgctctgctgggcgccaccggagccggggttgtacgaccctgcgctggcgttctgtatgctccacgagtcaatctgcgactgcatggtcgcgatgtccgcggcctcccgagcggactgagagctcaggctccccttctgcgcctccaggctggccctggcttgggcgccctgatcgcgcagcgccttgagctggtcctgcttggtctgggcgtcctcagccgccttctgggccgaggcggcctcctcgtcggcctgcttcttcagggtggctatctgcttttcgatggcctccaaacggtccttgcggttcatggaggtgttcatgctgcccgccgcgtccgaggcggcattcgcctcgcttcggctgacggccgcgtccgactgcattttgcccacgaactcctgggtgttggaggacttggtcaccaggttcatcacatccgaggcgtcggaaccgtggaagcccttacgggccatctgcgccacagcgtcctttgcgtcgtcgtagtcgatcccggactgcttgatcttctcctccagggcttgcttgtctttcttagcggcctccagtcgctcaccggtcgcctgggcctggctcttggcctgctcggcgctctgctgggcctgggtcaaggactcctgggcggccggaatctcggtgttgttcaggttgttcaaatcctcaatctgctgggccagctcggaggagacgcccgccaacttgttcttcaggtactcgttggtgttcaccttctgctggtattcgctccagctgaccgcctgggctttgggcgcgtccacgaccgcggaggtcaccgcccccgctaggagggcgcagctggccaaggcgaagcctacgaccgcccgcatccgcttcattcgaatcaagctttcacacccttccctaaacgcgattcccttactcactgataagccaacattctatgtgaagaccctggagggagccagacgggaccgtgtattttcgcgcgaccatcacgtccgctccccggcgaacccccgtcaagccttcaaatagcgccgcagggagaccgtggaggccagggcggagagggccaccgcgccaagaatcagggcgggggccatcagccagaccgtgctctggttgatgtaaggcatccactggaccgtctgggccagccaatcggtgacgaagagcttaacaatcgccgacagggcgcccaccgccagcaaggagcccaacaacgaggcgaccatgccctccaagatgaacggcatgcgaatcgtcatgttggaagcgcccaccaggcgcatgatctcggtctcgttcctgcgcgaggccgccgacatgcggatggtcgtcccagtcagtaagatggccaccaacaccatgaccgcggccaagaccacggtcacgaccgtggcacggttcaatatcttgaagaccggatcgaagatctggcgctggtcctgcacctcctccacgccgtcacggccggagagcacctccgagaccacctgatacttggtcgggtcggtcaacttgagccgcagggagtcctgcatatccgcggcggtgagggtgcggccctggtagacgccattcggatactgcttgaggaaggtgtccttgtagaagtcctcccggctctcgtaggaaatcttggagacggaatcacccagctcgctgtggatcgtgttctccatctggacgatttgcgccttggagggagccttgccagccgcgcaggtggcggcctgggatgcgccgtccgggcatagccagaccaccacctccacctgggaataccagtcgcccttggctttggcgatttgcgcctgcatcaggcccgaagcgccgatgaaaaggaaggagatgaaggtgacgagcatgaccgacaagatcattgaaccgttgtgcttgaggctgtcccaagtgccggacagtatgaatcgcagtctcatgcctgctccccctcgctctcgggcctctcagccgcggcccgcgcttgttgctggatgccatccgtccgctcatcagtcccttggggcttttgcgggggcaccggtggcgcggccttaccttcctcgggagcatccgagggtcgctgggcctcttcggcggcctgggcctcctgcgtcgtggacgcctcccccgcctcatcgccttcagaggtttccgaaacctgtgcggcctccacgtccgccgcctgcccctgggcgatttgctcccggacggcctcctcgtccaagcggagccccttaccccaggtcagggtctcttcgaccggggcgaaggcttcaccgtagcggccggtgcggcccgagtgcactgaagaggccaagcgcgctatgccggcatcgctgaattgaccgtcggtcgccatatccgcagcctgcacttgccgttgctgcggctccttgccgagcgcgcgctgggccctggcctccacgtcggcgtcggggaagaacttggcggaatcgtacgaaccctggcgctcatcgcgtacgatgtggccaccgtgcagttccaccacccgcttgcgcatggagttgacgatctcctcattgtgggtggccatcacgattgtggtgcccgtgcggttgatcgcgtccaagacctccatgatgcctaaggaagtggtcgggtccaagttaccagtcggctcatcggccagcaggatgcccgggtggttcacataagcgcgggccagggccacacgctgggcctcaccgcctgagagctcgtgcgggtagttgccctccttgccggtcagtccgaccgtcttcaggacctggggcaccatggtcttaatggtggagcgcctcgcgccgatcacctccagggtgaaggccacattctgccagaccgtgcggttggtcaggagcttgtaatcctggaaaacgaagcctatcgaacgccggtagaggggaatttggcggttcttcagacgacgcaagtcgttaccggcaacgcggatctcgccctccgtagcctcctcctcgcgcaggagcaggcgcagcaaagtggtcttgccggagcccgaagcgcccacgaggaagacgaaatcgccccggtctatctgcaagttcacgctgtccaaggcgggacgggtgccctttgggtagatcttggtcacatccttgagcgaaatcagcgccatgcgctctccaatccttgcaaagctcgaaccccccgaacaaccagcctagcggagaggggcccagtccgccccggaccgcgcccttcctcgcagaagcctcacgctccgccgccatctgaagcccggaactacctgccctcagcctcggcgcgttcctgctgacgctgctggtggcgccaacggatgcccgcctcaatgaaaccgtcaatgtcgccgtcgaagaccgattgggtctgcgaggtctcgtagccagtgcgcaggtccttgaccatctggtaagggtgaagcacgtaggaacgcatctggtcgccccaggaggcctttatgtcgccggccagctccttcttcttcctggcttcctcctcgtggcgcaggaccagaagccgggattggagcacggccatggccgcggcccggttctgaatctgactgcgctcgtcctgcatggtcaccacgatgttggtgggcaagtgggtgatgcgcacggccgaatacgtggtgttgacgccctgtccgccggggcccgaggagcagtaagtgtccacccggatgtccgagtcggggatgtcgatgtggtccgtaggctccacgagcgggatgacctcgaccgcggcgaaggaggtttgccggcggccctggttgtcgaagggcgagatgcgcaccaggcggtgggtgccgccctccaccgacaggcggccgtatgcgtagggcgcgtccacctggaaggtcgcggacttgatgcccgcctcctcggcgtaggacgtgtccatcaccttggtcttgtagccgtggcgctcggcccagcgcaggtacatgcgcatcagcatctgggcccagtcggccgcgtccacgccgccggcgccggagcgaatggtcaccacggccggacgttcgtcgtactcgccgtccaacagggtctggatctccatgtccgccaggtccttgccgatggattcaacctcgttctgcgcctcgatcagggtatcgtggtcgttctcctcgcgccccatctcctccagggtcgccacatcatccagccggctgcgggcagagtccagccgtttcaactggccttgcagggtcgagagacggctggtcacctcctgggcgtgctcctggtcgtcccaaagcccgggggcggaagcctcccgctccagctcgccgaccctcgttcgcaaggcgtcagggtccaacgccttctcgatcatgttgtacttggcctgggcttcgctcaaggcctgggagaaatcaaactccgccatgcttaccgtcatcctccgcttcgatgctgtttggctccgccgactcgaaaactcccgccggtcgtcaaaggtcgtgcgtgatggcggtgatgcctcgtctcttgcgcgtattcatcgtaagcccagtttacctggagcccctcacaagcaccggttcggcgaaacggccgaaccgggcatgcatcactcgtccctagcggtcagaatgatcgggtcgccctcggtgatggcgattgtgtgctcgctgtgggcacctcgggatccgtcgacggagcgcaaggtccaaccatccttagggtcctggaaaatctcgtcagtgccggccatgaaccagggttcaatcgcgatcaccaaacctggacgcagtttgaagccgtggtgggcggagccgtcgttcggcacaatggggtcgccgtgcatgacgtgacccaccccgtggccgccgaactccacgttgacgctgtaaccattctcatgcgccacgtcgccgaccgcagcggagatgtcgcccagacggttgccggccctggcctggctgatgccggcctccagggcgtcctgcgtagccttgatcaggcgcaggtcctccgggtccgcgtgctcgccgaccaccaggctgatggctgaatcccccacccagccatccacgctaatcgccaaatccatcgacaggaggtcgccgtcgcgcagggagtagtcaaagggcacgccgtgcaggaccgcgtcgttgaccgacaggcaaatgtagtggcggaaggggccggtgccgaaatcgggcgcgtagtccacgtagcaggactcagccccccgacgcgactcgatctggcgcttgacatagtcatccagctccagcaagttgacgccaggcttggccatcgctcgcaggtccttcaggatggagccgacgaacttgccagcgggcttcatctgctcaatctcttgtttggtcttgatctcaatcaccgttcatcggtcctttcacagcggagcgtccctccccactctaagcccggggctccccgtgcgccagactcagcgccggcgaccgaaggtgaacgcgcgaatcagggaggcgacacccaggacgacgagcgcgcaggcgccgaagatgacaaggacgacggtagagcccatcgggttgatcaagatgaaaacgccggcgatgatcgagactaccgcgctgaagatggcccaacccgagtggggcacggcccaggattcggccagggtcatgacgccttccataatccagccgatgccgacgatcaaggtgaccaaaaccaacagagtggaagcggatacggtcgtgttcttcacaatcacaacgccgccaatagccagcagggctccaatcagtacgctcagcacccgccagccgcccggcaacccctgggccacgatcgaggtaatcaggtggacaaggccggtgatgatgaagtagacgcccaaggccacggtgaagacggtcagcgtcttacctggcacgatcaggagggccaggccgatgatcagagccaccgcgccgacaatgccgaacacggccctgaccaggttcaccgacttggacgtcagatcttcgacgattagcctgaagggatctcgggaccgctgaggccctccgggcatttgctggtacaggtcaggcccgtatggcccctggctctcgtcattcatagtgaatctcctcgtactgttccatggctgcgtaccataatcattcctagtgtatgcgtccgaaagaggcggcagaagacttacgccgacattgcgcatggcggtaaattcacgcgccacaggcacttcgagagtaaaatggccctccttgcaggcggcaggggcagggtttacgcttgaacggtatggatcatacacagcgcaagtccgggctcgacccggcatcattctcctccgtcatcaagccccaggacgacctcttccgcttcgtcaacggcccctggatcgacacctacgacctacccgaggaccgttcccgcttcggctccttcgatcagctggccgaggacgccgaaggccagatccgcgatatcctggaagacccggacagcccggcgaccaagtcggccatcatctacagcagctttctggacaccgacgcaattgaacgcgccggactcgatcccatccgccccagcttgcgggccatcgacgaagtggccgacaaaccggcattgaccgccctgttgggttcaatgagcccggctggcggccccgacctgttcgacatgggcgtctacggagaccctggcgaccccgagcataacgtgattcacatcgcccagggcggcctgggcctgcccgatgaagcctactaccgcgaggaccgctacgagcccatccgccaggcttacctggtcatggtgggacggatgctccaacttgcgggctatgccgctgaccaggcgcaggcggccaagcaggcggagcgtttcatggccttcgaaacccgaatcgcagcgcagcactgggacaatgtcgccacccgcgacgaggacaagacctacaaccccaccaccttcgccgacctgaaggcggccctgccccaattggacatcgaggcctgggcccacgcctggcaggacgcttattcagccgccgaaggcgccgacacccaaccggtggacctgctcggggccttggaacacacgatcgtgcacgagcccagcttcctcaccggcctggatgccctctggcgggacagcgaactggatgacctgaagctatgggcccgggtgcacacgatcatgagtcaggcctcctacctgagccaggatttcgaccagaccagcttcgacttctacggcaaagtgctctccggggcccagcgcatgcgggaccgctggaagcgcgccgtctctctggtcaactcgatctgcggcgaggaggtgggcatggagtacgttaagcgccacttccccgaatcctccaagacgcgcatggaggagctggtcgccaacctgatcgacgcttatcgggcctccatatcctcttccgactggctgggcgagcagaccaaggccaaggccctggataagctctccaaattcgagccaaagatcggatacacccgaaaatggcgcgattacagcgccttccggccttcagccgaagcgagcctagccgagaacatgcgccgggcgtccctgtacgagaccggctacgagctaagcaaggccggccagcccgtcgacaaggacgaatggctaatgaacccgcagacggtgaacgcctactatgagccctccctgaacgtgatcgtcttccccgcagccatcctccagcctcccttcttcgaccctgaggcggatgacgcggccaactacggcggcatcggttcggtgatcggccacgagatcggccacggcttcgacgatcagggaagcaagtacgacggcgatggccgcctcaacgactggtggaccgagcaggaccgcgccaacttcgaggagcgcacggccaagctgatcgcccaatacaacggttacgtcccccgccagatagcagacaagcacgcggatgaccccagccaggcaccacacgtcaacggcgccctgaccataggtgagaacatcggcgacctgggcggaatgaacatctcgctcaaagcctacgcattcgccttgcaggaggcggagggccaacctagggacgccagcccggagggcatcagcgccgcgctggctgcggccccccggatcgatggcttcaccggactgcagcgcttcttcctgtcctacgcctcgatttggcggtccaaggagcgcgacgagctggccgagcagtacctgcaaatcgacccgcacgctccggccgagttccgcaccaacggcatcgcctcgaacgtcgacaagttctatgaggcgttcggcgtaagcgagggggacggcatgtggcgcgcccctgaccagcgggtcagcatctggtgacccaatgacgaatcggcgcgggcggtcccactggcttgtggcggctgcctgcgcacggtcgtcatggacgagcaggcgacggtcgacgggcgacggcctaaaaagggtccatgaccagcggcggcgggctgtccacctgctcgcccggatcagcggacgggctttgcttgaatggatccccgggtagcgagttggatggctccaccggggttccttctatcccgctgacctaccaccgccgccactgccggcgcgcttgcgcctgcaggatgattgggctggcctccctccatgccccgcgtccccctggcggacgacgaaccgactttcacccgctggaagatggagacccccaagttcaggtcgtgccccacgccgtccgcctctaggacgagggacgagcgcttctgcccgtccttgacccactcctcggtggacaccgatcccgtcaccagaaccgggtcgcccttgcgcaccgattgaagcacgttgttagccagggatttaaaagccttgaccgtaatccacgtagtgggaaactcgcgccaggcttgggtcctggcatcgtagaaaccgtcggtcgaccccaggcggaaggtgcacaccggcgtgccgccctcctgccccacccgcgtggggtccttgcccacgaatcccgctatcgtcatcctcgtctggtgcatggccatgcctgctgccctcctgaatcctatggtcgatggtccttccccgcccacccgaagcggccgagtgtggaccgcaggccctgaccggtcgacggacagcgtctgcgctcacctccgcccgacgccgccagccccatacggcccaaggcctgcggtgctcccatcatgctccgcagcgtccgttcaagctggcgattcccggccttgtggtcgaatgtggctcccgccaagccgatgtggataaccgatcgtggataaatcttctgaaggcgcaggtcagctgcgccgcttaaactaaggctgcatcagccgctcaagccagcagagaggaccttacatggcctacacgttcatctcgtggaacatcgactccttgaacgcggccctggctggttccagcgagcgctcagccctgtcccggcaggtcgtggagggggtggaggccgcccaacccgacgttttcgccatccaggagacgaagctcaacagcggtcaggccaagaagaccgatgccttgatcgagcagctccgcagccgcttccccgagtatgaagtggtgtataacacctctgaacctccggcgcgcaaaggctatgcgggcacgatgatgctctacaagcgctccctgccttcgccggacgtggaccgccctcaaatcggcgccccggatacgatggatagcgagggccgcatactcacgctggaattccctgatttcttcgtcgtcacggtttacacgcccaattcgggaaacggcctggtacggctcaaagcgcggcaggtctgggacgagcgcttccgcgactacatccaccagctcgacaagcgcctgccggtcttcgttggtggtgacttcaacgtggcccacgaggagattgacctggccaacccccagaccaaccaccactcggcaggcttcaccgacgaggagcgcgccgacttcacccagctcctggacgctggcttcaccgattccttccgcgagctccacggcgatgcggcccccaccttccgcgacggcgactccgagcgctccatctacacctggttcgcccagcgcgtccccaccgccaaggcccacaactcgggctggagaatcgactactggctggcctccaaccgagtcgccgactcgatcaccgcctgccacccactggacaccggcacccgccaggaccacctccccctagagctcaccgtcaatctctgatgcggcgcgcgaccgctgctcctcttgagtgattctgactatgaacagcacgcgccaccgacgagtcttggcatcgtatatgcccgggcgcgtcatagtctgcgcaactcgattcccggcgcacagggcaagcggaccgtggcgcatgagaaaacaaaatggcagaccactctcaagagcaatctgccataggatgggcttccataactgggaactaggctaaagcggctaccctctcagcgatggtttgggcggcttcggcggctgggacggcgactgagtcggagccgtcgcggttgcggatttcgacggtgccgttggacatggtgtcgcggcccacgatggcgaccagggggacgccaatcaactcggagtccttgaatttgacgcccggagagaccttgggccggtcatcgtagagcacctcgatgccttgcgactccagctcggccaccaaccgatcggccttctcgaagacctcggcctgcttaccggtggccagcacatgcacctgggcgggcgccacagcggcgggccatgccaggccgtgctcgtcgtggtgggattcggcaatgcaagccagggcccgggagacgccgatgccgtagcagcccatccacaccgggacggccttaccgttctggtccaggaccttcagatccaaggcgttcgaatacttgagccccagctggaagacctggccaatctccacgccacgctcaaagctcagtgggccggaaccatccgggctcatgtcgccctgtcgcacctcgaccgcctcaaccgtgccgtcagcctcgaaatcgcgcccgtacacagcgttgaagacgtgcaagccctcctggtcggccccggtgatccaggcggagccgcgggccacatgggcatccatcaggtagtgcaccggctcggcgatgccttccttctcctccgcctgcggacccagcactcgcggaccgatatagcccttgacgaactcaggatgcgctttcaggtcgtcctcgttggcttcctcgatctccgccggcgcgaactgggcttccaagcgcttcatatccacctgtcggtcgccgggcaggccaatggccaccagttcgcgccagggccgctcatgctcgtcatcctcggcgtgcttgaccgcgatgatgaggttcttcaaggtatcggcggcggtccactggcggccatcctggcgcgggtgcagcgcgttggcctggtccaccagcttttcaatggtcttcgagtcaggtgtctccagggcctccatagcggcggttgcggagcaatcgacatcctccacggccggcgtggtcaatgcttccacgttccaggccttgccggagggggcgagcgcgaacgtgtcctcgccaatggccagcggcgccaggaactcctcggactcggagccccccataggcccggagaccgcgcggacgatgacgtagttaagacccagccgctggaagatgcgctcgtaggcggcgcgctcgtcctggtaggcctgcttcaaaccatcctcgtcaatggtgaaggaatatgcgtccttcatgatgaactcgcgcccacgcaccagaccggcccgcggtcggaactcgtcacggtacttggtctggatctggtagagggtgacgggcaggtccttgtaggacgagtacatgtccttgaccaggagggtgaacatctcctcgtgtgtgggagccaacaggtagtcggccccatgcctgtccttcagccggaagatgttgtcgccgtactcctcccagcgatgggtggcttcgtagggctcgcgcggaagcagggccgggaagtgcacctcctgggcgccgatgccgtcgatctcctcgcggacgatggcctcgaccttgttcaacacgcgcaggcccaacgggagccaggtccagatgccgggcgcggccttgcgaatgtagcccgccctttgcaggagccgggccgaatccacgtcggcatccgccggatcctcacgaagggtgcgcaaaaagagggttgacatacgtaatgcagtggctttcataagcctcagaatatgcgctttcagcgacaagaccggcggtcagacaggccgcggatttcgattcctcccaccaggacggaggcagtccgctcaggccacaagcgatgctctaggacggggaagggaggggtgcccccatgtctgtggcgcggatgggcctagcgcagcaccttgtgcaggggaccatccaatctcaactttcatccaccttggcgccagggtgggggatgcgtgcagcgtatgagacccaccgattccgggccaaatgctgatccgagacggactgaaccggtaggggtcaccgtgtgggccccgcccccaaccgtccgttgaggacggcaccaccgcgcggctggaccgatgcgcccgaccctgctatcccagaccccggaaaacccccagagaaccaaggagaggaattgggcgaagccgtttagaagagcgcgtcctggccgaattcatcctcctcttggcctatcgcttgcttggcgaaggagcccgaaccctcgtcggccaggcgtgaacaggcgatttgggagttggctcgcagctcggaatcaaggataacggcctcgggcgaaaccaggaaggcgtgctcgttgatgccgtccaggtagagcccgtccaaggcctccacgcgggagagggccacgtaacccatgcccggggcgaaggtgcggcgcaggtccatgacggcacgatccagggtcatgccctgggacttgtggatggtgatggcccaggcgcagcgcaggggcacctggttgaccgccgccagcacagtctcaccgtccatcatctcccaagccgcaggtttcatcgtgacggtattgccgttctcgaaggcgacgatcggccagccgcccttggccaggggcgcgaaaccacagaccgtgccgattgaaccgttgacatactggtggtcctggtcgttgcgcagggccatgacggcagcgcctgttttgagctggagcctttcgggggccagcatattcttcttgagccgttccaccagtcggggctccccggtctgcgtggaggcgtattcgtggggttcctcggtgatttgcgccaagcgcaggtcgttcaacgtgtcggcctggcggttgacggggaaaaggtggacggccacctggcctggctggggctggatgccgatgcggccggagagcacgtcatggtcctcctggctgaccgaaccttcgcggatgtcggtcaggacggtcagcagttggccgtcatcctggcggtgctgctcggtcaggtagcaggtcacaggctccagctcatcccagaccaaggattccgtcacgaaaccctccgggtccttgcccgcctgggcgtaggcggcccgggaggtttggaactcgggactggcagcgaccaggtcattatcgcgcacggagcgggacactggcggtaattggaagaaatcgcccgaaagcaccacttggatgccgccgaagggctcagggctgtggcgcacagcccggcaggcctggtccaccatgtcgaaaagccaggcgtgcatcatcgaaacctcgtcaatgaccaggatgtcagcggaactgatttgccgcttgcgccggctcctgatccgcttgagcaagccgtcggtcatgaccttggatatgcccacgccggaccaggagtggatggtttgcccattgatatgcgtcgcggcgatgccagtcgaggcggtgacggccaccttggccccccgtcggcgggctcgggcgatgaattcgttgagcacgtaggtcttgcctgcgccgggagcgccggttatgaagacgttggcgcccgcgtccaggatggtcagggcttcggattgctgcatgattccatgctccctcgcaggcggtacaggccgcgcccggctctaatagtcctttttttgcggggtggcggtgtcctccacaggctggccttgggcctcataagcgcgcaggagggaggtatcctccacccgcctggcgccgaccttcgcggcctgggcgtccggtccgggagcgggggcgaagaacatgtccctgtagtagcgcagctcgtcggccgattcgatgatgtcggccaaggcacggtggccaccgtgcttggcgggcttattctcgtacaccgccggataccagcgacgcgccagctccttcaaggtggacacatcaatgaccctgtaatgcaggaggtccatcaggtcgggcatgtagcggttcaggaacttcttgtccgaacccacggagttgccagccaagtgggccttgccccgcttcggcaggaaacgcttgacgtaatccacgacttgccgttgggcctcctccaggctcaggccttcacggttccattcatcaatcaggccggaggaggtgtgcatccggcgcacgaaatcacccatgtggctcacggcggcgtcggagggcttaatcaccaaatcaatgcctttgtccagcacgttcaggttgaagtccgtgggcacgaccgacacctcgcacaactcgtcatggaagatgtccaatccggtcatctcgcagtcgatccaaatcatcctcgactcttccggggtgaaggtcacatcgctcgtatcgctcatccgtccgtttccttccgctgcttccatggctcaggtccggcgcgggaggccaagccccgcgccgaacccatcagcttaccgtccaagggcgaccggtctcaggccgcccgccgccctcagtcgtggaaaccggagtagttgggggcttccttggtcatcacgatgtcgtgagggtgggactcgcgcaggcccgcatcggtgatgcggatgaagcggcccttctcctgaagctctggaatggtgcgggcgccggtatagaacatggtctggtgcaggccgcctaccagctcgtaaagcacgtagttgagcggtccacggaagggcacctcgccttccacgccttcgggcaccactttgtcggacgagctgacatccgcctggaagtagcgatccttggagtaggacttcttgccgcgcggcgccatagcgcccaaggagcccatgccccggtagatcttgtactgcttaccgtgcagaaggactttctctcccggtgcctcggccgtccccgccaacaggccgcccagcatgacggtgtcgccgccggcgacgatcgccttggctatgtcacccgagtagtgaatgccgccatcggccaccaacggcacaccagcgggcttgcaagccagggaggcgtcgtagacggcggtcagctggggcacgccgacaccggccaccacgcgggtggtgcaaatcgagccagggcccacgcccaccttgaccgcgtcgacgccagcgtcgatcagggcttgcgccccttcgcgcgtggcgatgttgccaccgatcacatccaccccgtcgaaggcgctatcggacttgatccgtcgaatcatatccagcatgagcttggcgtgcccgtgggccgtatccacgaccagcacgtccacgccagcgtcgcgcaaagcgcaaatccgctcccaggcgtccccgaagaagccgaccgccgcagccacacgcaggcggccgcgctcatccttggtggcgtccgggtactgctcggtcttgacgaaatccttgacggtgatcagaccagccagacgccccgcgccgtcgaccagaggcagcttctccaccttgtacttggccaggatccggtgggcatcctccttagtgatgtcggccgggccggtaatcagcccctccttggtcatcacatcactcacccgcaggcggttgtaatcctgaggctccacgaagcgcatgtctcggttggtgatgataccgaccagccgctggtcttcgtccacgaccggcaggccggagacccggtaggtggagcagagcttatccagctcggccaaggtggcgtcaggggtcacggtcagcggatcggaaatcattcccgactcggaacgcttgacgatgtccacttgattggcttgatccttgatgctcaaattgcggtggaggacaccgatgccgccgttgcgtgccatagcgatcgccatgggcgcctcggtcacggtgtccatggccgccgacaaaatcggcgacttcatcgtgatgcgacgggtcaggtgagtggtggtgtccacttcggaggggatgacatccgactcattcggcagcaaaaggacatcatcataggccaagccaagtttttcgaacttagggggcacaggctggtagatggactgatctggggaagaatgctcagtagacataacaacatgatacagactgccgcagacgtgggatgggcccgcaaaccctactgccgggccctcccctgcccgcttcctcctgcgcttggcccctgctgggcgcgcctggcttcggccagttgcgcgttctcctggcgcaattcaggcagccttcgcaaatagtaggggaagagggtcgcgatggtcagcaaggcggccgcgactgccagacccagcatcgcgtagcgcaccggcacgaacaggatggtcagcgagccgaaggagaagagcgccgcccaaccccagaggatcagcaccgccgactggactgagtggccgatcctgagcatccggtgatgcaagtgcatgcggtcggggtgcataggcgactggcccttgctcaagcggcggacgatggccaggcacatgtcgagcaccggcaggaagagcaccaggatcggcaggaggatgggcatgaaagcaggcaagtatatcgaagtgtggatggtggccgggtccaggcggccggtgaccacaatcgaggcgcaggtaatcaagtagcccaggagcatggagcccgaatcgcccatgaaaagcttagccggatgccaattatgcagcaggaagcccacgcaaatgcccacgagggccacgtcgatcagggtggccatcgaggcgtaggagggcgagaagcgggagatgacataggagtagatggcgaaagcgatgccgcctatggctacgatgcccgaggacaagccgtccaagccgtccacgaagttgaccgcattgatcgaggcgacgatcaggaaggccgtgatggccatcgacagcgagggcgaggcggtaaccagtgagcccaagggcagggagatgatttgcaacccgccccaggagacgaagaccgagaccagaagctggcctgccagcttcagcatccagtccaaatcccacaagtcgtccgccatgcccaagaggcatatggccaccgctccgcccaggaccacccaggcctggtggcccgtcttgaacaagcccgatatgaacgggatgcgcgcggcgaagaacatggccgtggcgaaccccagcagcatggccaggccccccattcgcggggtggggaccgtgtgcacgtcgcgggcccggacctctcccaccgcgccgatcctgatggccagatgccgcactaatggcgtcagaagccaggtggcgccgcctgcgatggcggcgatgaacaggtagaccctcatcctcgcccgccttgcctgcccatgcctagggcctcgaaaatccgatcggagccgatggcaccttgcctcaggatggtcacgccaccgggttggtcaggttggaccgcgacaaccgtcgagggggttgggcccttggtggatccgccgtccaagtagagcgcgacccggtcccccaactggtcgtaggcctcctggacgctctggacgctgggatgaccggagatgttagccgaggacgcggcaaggggcccagccgcggcgagggcagcccggcagtcgtcgctgtcgggcacgcgaacggcctgggtgaggccagcggcctcctggcgcaaggtcttgagccggcagtcgggcctggccaggcaaatgggagagaaggcaccaggcaggaaacggctggacaggcgggccaaggaatcaggcaggtccagccccagctggtcgatggcggccactgagggcaaaaggacctgcagggacttgctcctgggccgctccttggcggcgaagagggtgtcgatggccgcatcgctgtatgggtcacagacgatgccataaaccgtgtcggtggggatgaccgccaggccaccggaacggatcacccgcctgagttcagccagggaatcctgattgatggccgctatcacgcccatgcgctcccgcctctccgtcctcgaacccgaacactaggcgcacccgggggcgcaccattcaccaccctattgtgccccaaggcctatgcaaagggcgcgccctacccgcgctcagggatcacgtccagcagggccccgccaggcgaagcggctcgttcatgcggtgaaagcggggaccgccgcccctttgtagatgctgttgatcgtgtcggccacagccttggtgtgataggcggcgacgaccttacgcaggaccgggtcgtccttgcgatcggcgttggccacgatgatattcacgtaagggtggttggctgggtccttcaaatcgtagggcacttgaaagatcgcatcggtcactttcatccccgcgtcgaccacgaagttggcgttgacgacaccgccgccgtagtcaggcaagaggttgatgatgccagccggatcggtctgttcgatcgtcaggtgcttagggttgtcgcgcacatcctcgggcaccggcgttgtggtgttggggtcgcgtagggtaatcagcccggcccgttccaggactttcagggcccgccccatgttcgtggcgttgttgggaatcgccaccttggcgccttcaggtatgtcgctgactcgcttgtaccgcttggagtacaggttcatcggcgagatgtaggtgtcgcccaagacggccagatggtagccgttggtcttggaatcgttctccaggaaggcgtagtgctgggccgcgttcaggtccacttcgcggttgttcagggcctggtttacatagatggcgtcttggaagggcttgagggtgacgtgaatcttgtcgcccctgcggtccatctcagcttggacggccttccaaatctggtcgtcggacgacccgatcaccgcgatcttgacctcggtctcgtcctggccgcccccgtgcaggcggtaggagaccccgcagacggcgaccagggccaccacgatcagggccgacaggaccgccagctccaccttggccttgcgcttgccgcgcgccgacttgactgttcccacgatgctccctttccgctcgtttccccgcctgccgcaccagcccggcgggctccctcagtgttcgatgacctcggccagcaagcggccgaacagttcgatgaccgcgatcagcaccaccaggacgatgatcgtggcccacgtcacgtcgtacatgtaacgctgatagcccaggcggatcgcgaagtcccccagaccccctcccccgacgatgccgacggtcgcggtctcgccgatcagcgatatgagcgtgatcgtagtgacgcggatgatcgacggcacgccctcacgcaggtagacgtggcggatgacctgccaggtggtcatccccatggattcggcggcttcgaccagcccggcatccaccgaggcgagcgcggactcgatctgccgggagaagaaaggggtgatgcccacgaccagggggaagatggcgcccctagggcctatggccgtacccatcatcatgcgggtgaccggcaccagggccgccgcaaggatgatgaagggaatcgagcggaagagatcgatcagcttgtccaatacattgaacagcaggccgttgcgtttgatccccccgcgccgggtgaccgtcagacccacgccaatcacaatcgagagcaggaaggagatcaccccggagacggagaccatgaccagggtctgcatgaaagagtcgaaaaactccggcagacggctggccacattcgggaaccaggattccagcagttcagccacggtccaacacctcgattccgatttcgttcgagcgcatgtattccagggccgcgcgtatgtgttcgcccgagccttccagacgcaccaccagcccgcccagctgggagccctcgaccacgtcgacatcgccgaagatgatgttgacgtccaggtcgaaacgccgggagatggtggagaccatggcctcgtcgacggtcttggcggtgaagcgcatcctcaggagaacctgcccgggcttgagctggatgagcggcgagcccgcctcgatcaggtcgcccaccttgtcaaggttcgaggtagtggccacaaaagacttggtcagccaggcctgggggttggcgaacacgtcgaagacccggccttcctccacgatccgcccctggtcgatgacggctaggcgattgcagatctgacggaccacagccatctcgtgggtgatcatgaccacggtgatgcccagctcgtcgtgcaggcggcgcaggagcgccaggatggacttggtggtgttcgggtccagggccgaggtcgcttcgtccgacaggaggatgtcggggcggttggccagcgcgcgcgcgatcgccacccgctgctgctggccaccggagagctcggccggatagctctcccccagctcggccaagccgaccaactccaggagctcgcgggcgcggtcggtccgctccttgcggttcaggccggaattggctaagggaagcgccacattgcctaagagagtgcgtgaaggcatcaggttgaagcgttggaagatcatgccggtgcgttggcgcagggagcgcagttcgcgcgggctcagatcggccacctcctgcccgcgcaccttgaccgaaccgccctggtaggtctccaatccgttgaggcagcgcaccagcgtggacttgccagcgccgctcaggccgatgatgccgaagatgtcgcccttgtcgatccgcaggctcacgtcggacagggccgttcggtcgccctcctcctcggagtgataggtcttgctgaggtgggacagtgcgatgaccgctcgcccctcctgcatctcctgcctagccacgctccctcttttcctttaggtttacgaaccgcccggtggaccgtcctgtgactgcccgtcagcttagggcggagcggcggacagcggcaagccaggggttatagaagaaatctatgcatccctatcgccgggcgacgctggtctggtcctgggaccctcgcgccccggctaagcgtccactatgcggacgctgcaatctcattgcgcggatttcgccgccggtggctgagcttcctgctcagcggattgaggcttggcggcgccctcctgctgccgggccagctgctgagcgagttgctgagcccgcttctgggcttgctgctgggctttgcgggccacggcttcatccccggcgcgggtcggcgtagtcatgaacccagtgcccttgaggtattgcttgccaaccatgatgtcgtattggatgagctggtagtcatgcaagagttgcttggtgctctcatcgaaaccgcgggcgtccatgggcttgccctgggcgtccaggtagatcgtctgcccctccgggatccgctcccatccctggacctggttgaccaccggcggttccatagccgacaccttgccccgcaggcgggtcaggaaggcctggtagggggagaccttggcgtccatatgctcggcggcctgggtcgcgaaaaagttcggcgacgtgtattgcgagtccgacaggttgacgtcacgcgcgggcgacgcctggttggaccagatgaagtaatcggtcaggtgcagggccagggagttgctctggtcagcgccggctgtgttgtagatgccgggcaaatgatcgccgtagaagacgactgtgaccggcttcttcaactggtcaatcgagtacaggaagcttcgggtggcatggtcggtcaggttgacccccttggcgtaggtgcggatggagttggcctcgtcgtcgcctaagggcagggccccgtccgctgcggacacctggaaggtattgccgttgtaccagtcgttgtagggcatgtggttctgcatcgtgatgacttcgacgaactggtcggacttggccgagcgcatctcctccaaggccgagtcgtaggcggacttgtcggagacgtactgggatctgtcgatcttgtcttggtggtcgatcacgtctgggccggccagggagtagaagcgggagaacccgaaggtcttatagttctgggcccgcgagtacatcgagggctcgtaggggtggaaggcctgcgaattctccggcgcgccccaggcctggttgaccgtcggcatccacttgaggtcggggaccacctgttggtaggggctggtcagcgacgggtcgaaattggccatagacaggccggagagggccatgaactccatgttggccgtgccgccgccgtagccggaggaaagcatgtagccggaggtggtgttgcgcttgatcgagcgaatcttcggcatcgggtccatattcacctggaggccaggcacacgcgtggggtccgagaacgattcagagaggatgtagaccaccgtgctctcgttcatgtaggcggaccgatcggcgttgatcgcggccgcgtccttggcgtagcggcgcgacagggacttcatcgtggcttcgctgtaatcagcgggccggtccatgactttggggttcagctggcgggagaaggagacaaaggtgccgttgcgttgggaatcgtagaccgaatcccacatggagggttggtcgcccatccaacgggcgaaggagttggcccaactgccatacgtccccacggccgacatgaacaaggccaggaccagcaccggggccagaaccccggccaggcgcagggaggcgcccaagcgcttgttgccacaggtcacgacccggcccttccagcggtcggcccggcccagcaggatgcagacaaggaccaccagggctatgacgataacggtcgagacgatggtccatagggagccagcgggcaggaaggtcacgatgttgccggcatccgcatggaggaagtccaagtcggaggggagcacggtttcgtagcgggaaaccaccttgaagtgctcgatgacggcgatcagggcggacgccaccagcaggatcggggtggccgcccagaaacggttggtcaggaagagcagggccaggtaaaccaaaccgatggccaacaggttcagcacgaagacgaagcgccgatcggtccacatggccgacacgaatccccagaagccgatcagggggttggacaaggccacgcgggaggactccagcgtcacgccccattggagcatggccacagccaaggcgtcgaagaccacgaagaggagggcgtaagcccaggtgggcaacgccatcgaaccacgcaggagaaagccgaccctgctgcggtggcggctttgacggccgcttggcgtacgggtcccccggtcgcctaacccaccgtcgacggttgcgccggtcaactcgcgttcagcgtctcccatttcagattggtctgatatagccgctggtttttcaagcataatggcctattctccccgtcatccccgacaaggccccactctcagcgcagcagggaacctgtgccgccttagcccaaggccctgccgaacgaatcggccaggtcccctatccaatcctccaggcgcgagtactgagccggcatttgctcactgaccttcacgaccggcaactcggccttgtcggctgcggcgaccagcccgcggctgacctcggtgtcctcctgatcgttgtaaatcaagagcttgagccgacctgaccctatgaggacctgaaaatcgtggatgtcggccggagagggctcgctttcgttagaggtggcccgcaggtaaccgatcggtgtgagatcattgagccccaggtcgtaggccaggtaatccgcagccgattcggtggccgcatacgagccgccgccaatcttcttggatgccgcggcgatgcgcccttcgagccgctgctcgcgctcatgccagagcttataggaccgctcgaagtggcccttgtcgccggggcgcagttccttgtaggcctgcattatgacctgagcggcgtgttcgcgcgcctgagaggagaaccacaggtgggggttgtcgcccgagcgtttgccgctgctagcggccacatcgaccacccgccggccattgtcccgcgcggctttaccagcccaggtgtcatagtccgccccattgaccacaaccaggtcggcgccgctgatcgcggcgatgtccttggtggtgggctcataatcgtgggcatcggcgttgggattgttgataaccgcgtggacctgtaccttgtcgccgcccagctccaaggccagggatgaccactgaccgatgctggttaccacttggatgaggcctccggacccgccgcccgcaggcccgcaggccgacagcggcaggagcgcgagagccagcagcgcggccagtaccggccgcagcgggccatgcgcggtcgtgattcgctccatcatgagatctgtcagcatcacagactcgtccttccatgtcggcaaagcatccgacgaccttcattatcagtcgttaatgagattagttatcattaactatagcatggcccgttcccatcatgagatctcatcgtgagtgctatggctcgatatacactaaaggcactgatgaggaagaaaggtattcatgttcaagaggttcggccgcgtccatctgatcgtaggatggctccccatcaccgttttcaccataaccggcttgggactggtcgcactggcggtcggctactgcctggcccgtcaatggaaagccctgggccagcgcctggccgtggcgctgatttccgccgctgcggggctcctggccacctggctggtctcggacgttttcatgctcttcgaggtgagcctcggatggatggtcatcctcacagtcgccgctggcatcggcgccctgagcttcgtcatcgcctgcctggtcgcggaccgggggttcaaacggatcctgtcatcactgatgattgtgccggtcatcctggccacggccctgcgcatcgacatgatttacggcgaatacaccacgttcggttccatcttctccgtcccgatttacccgcgtcttgagccaaacaagaccaccacagcccagatgagcctggagcagtggcgcgattccgccgcccaggggcacttacccaaacacccagcaaaaggcgagtcctattcagtccgcatccccaaccccgcctcgcacttcagcgcacgcgccgccgatatctaccttccgccagcggccctgtcctccaaaccgcccgccctcccggtcttcgtccttctggctggacagcccggttcgcccgaccggctcttcaccgccagcggcctccagcagatgatggacgcatacgcagccaatcacgatggcttggccccaatcgtcgtctcccccgaccagaacggcgccaccacgcacaacagcctgtgcgtggattcgccggtctacggcaacgcggagacctacttgactcgggatgtgccggactggatcaagtccgagctgcccgtgagcgagagcccgaggatgtgggccatcggcggcttctcccaaggcggcacctgcgccacccagctagccccccgacacccccacctcttcggtgccatactgccggtcgacggcgagctggcaccccagcaaggctcccaggacgacatgatccgcgactacttccacggtgaccgcaaggcctaccaggagcaggtgccgaccaccgcgatagctcgccacgcccccagcaatcaggtcctcttcaccggcgccggctccagggacccccgctccatccgcaatatgatcaccattgccaaggcagcgcgggaggccggcatggacgtagtggcagccacggcccaaggctccggacacgactggcacgctgtccgctccacctgggagccggccctggagtggctcggcgaacgcatgggcttgggccctatgaccaagagcatggaccagtatacggccatccaactaatcgacatcagccaacagcaggggaaagagcaagcatgagcgagacaggtaaaggacccagcacgatgggcaagtcagccttggccgtcctgggcgacgatctgaagcactggttgcgcatccatacgctggctgtaacctccaccctcgtcttggtggtcgtcaacctattcgcctggctggtctacgccctcctgcgcgtacccaaggccgaccaggccggcatgcccctgtccgacttcctggcccaccccccgatggccgcccagccgagcacccccctccagagcgatctcccgggccaatttgcaaagctcctgctgaccctcttcatcacgtccagccccttccaactgattgtggacgcagccctggtcctgctgatcctgtgcatagccgaaccccgcttgggcaggcggcgcacggtattggcctcactgatctccgcggtctcgggagccgccgtaggtctggctatctgctacgccatcaatgagctccagtcccactggacctggttcgtgcgcattcccatggccctgaaccccgtgatcctggtcatcggcgctctgatggccgcaagctccttcagcaacctcctgtggaggcggcgcatccacctgattggctacgcctcactgatcctgctcgtgctctacaccggcaaccccggcaactactgcgccctggcggcggccttgatcggccatttgaccgggcgcatctggcatggccccatcaccgaccgcaccctgcccggccaccgctcctactacgagacccggcacctgttgggcgccatctccgcggtcctggccctgggcccgatcgtcaccgcctcctccaaggtcaaggctggcattttcacccccttgggcatgttcatgggccctgggcccaccggggccgcccgcctgcaagactgcctgaggaccaatacggccgcctcctgctacacccaatacggcctgtcgcgtccagtcaccaccgcaacgttcatcggcctcctggtgcccacagcagtcatgctggtggtctcctggggcatctaccacggccggcgcgtggcggcgatgaccagcctggtcctgaacggcctgaccgtcgttctggccctggtctactaccttgtcgtgccgcttaccctgggcgaaggcctggcccgggccgtacgccacggagccgtgccctccctgctggcgatcgccttgccgcccctgattttcgcttacttcatatgccgttacatgcgctacttccccgtgcgcaccaaggccggcctcctgcgcgccggcagcttggccatcctgttggactggctgattaccgccggtctctacctggccgccgtcaccgtctcccccggctccttcaagccccgtccgaatctgagcatggccctggccgagttgcccgcgcgctacctgaccaacggggtggccagccgtttcaagccccgtttcgtgccacgcaccctcaccggtcaggtaatcaacaactccgtcggcttcatcttctggctggtcgtgctggtcgttcttcttttgtggatgcggagctcggtcctgcagaatgaggacgaacggctcaaggccaacgccttggtcgaatccggaggcgagtccatgtccttcatgaccacctgggagggcaacaactactggttctccccctccgggcgctcggccatcgcctacagggtcctgcatggcatcgccctgaccaccaccggccccttcggcgacccacacgagtaccaggacgacctgcatgagttctggcgctactgcacggagcactcctggtcaccggtcttctactcgatccacaagccccagcgcgacgacttggtcgcccacggttgggcctcgctggaggtgggctccgagatggtcgtcatcccctcccagtgggagacccgaggcaagaagtggcaggacatccgcaccgccatcaacaaggccaagaagagcaactaccgcgatgagctgtccacctttaacgatgcgccctgggacgtgcagtcgcaaatcgtggccatctccgagcagtgggccgagcttaaggccctgcccgagatgaagttcacgctgggtggcctggacgaactgcgcgacccgcgtgtggccatcctctacgccatcgacgccgaagggactgtcctgggcgtcacctcctggatgccgacctatcgcgacggcaagatcatcggttggaccctggacttcatgcgtcaccggaccgactcccccaacggaatcatggagttcctgatcgcccgcatggccgaacgcttgcgcgacgagggccaggtggagttcatgagcctatccgccgcccccttggctggcatgaacccggagcgggacaaccagggcgagaacaccccgcaaatcctacagcacgctctgcagctggtggccgacctgatggagcccgcctacggtttccgctccctcttcttcttcaagaagaagttccagcccgccgagaacccggtctacatctgctacccggacccggcccagctggtgcagatagggctgtccgtggtccaagcctatctgcccgacctcaaagcatcccaggccctcgacgcgctcaaatccctgcgcccagctaagaacgaggcccctaggaacggcaaagaaggcaagggcgataaatctgaaggcagcagccctaagagcagcagtcctcacggcaggaccgctcaagaatccgccgagccgaaggagagcaagccctccaccaagccagcgccgagcgcaccagccgcatccgcgcctgagcctgcgaaaccgaatcctgccgggccagcgaacgagacggtggataggcctgacgcgagctgagctcacggaatgtcattagcctcaacacggcgcgaagcggtggccggggcctatcacaggccccggccaccggtcgtatatgcgatgtcttgatacctgaaaaatcgaaacgtacacatgtcacggctgcggtgccacgaatcagagcaaagcgcattcggttcgtaaacctccgctggcatcaccgccgaagaaccgggaccatccgaggttgacgccaagaaggaatacccccccccccaacccgttaccgggcgcggatgtccccccccccccccctcattttttgtcacagaccgcatgggatgccgcttcgcgcgcagctcccctgccaaccgcgccgccacccttccagatgaccaccacccgaatacgctagggcatttccgggcttgcgccgggcccgctcagttcgggctccaacccctccctgcctattgggcatgatgtatttgtccgaaactagacgaggccccaaatcgtcgccgtaaatcggggctttcgtgcattgacgccctcgtgctgacaaagtacggttctgcgattcacggtaaaaggctcaacgtttgcggcgggcggccgctatcccctgcctgccgttccttgcgctggcaatccgagcacaggccgtatacctccaatgtatgggaggcgacggtaaagccttgcgcggcggccacggcacgcagccagtcctcccgcggcggctcaatttcaacggttttgccgcaggactcgcagaccaggtggtggtgatgcctgcgctgggcggcgcagaggcggtagagctgggaacccttgtgctcgatggtgtccacggaaccgttcttcgccagggacgacagctgccggtagacagtggccaggcccactggttcacccgcctcaaccaggagctcatgcagctcttgggcggagacgaactcgctttgggcgcgcaggacccggcggacggcctccttctgcctggtctgccgtgagttccgctctgtcatggtctcctcccccgtccgcccgccaagccccgacgggcacgtcgctcctacgtttgccaccatagcgcaggagtggccccatccgccacggtaaggacacgccccgtgagccctgggcgtaagactcacgcccccctctcccctcgcgttcctccgccctgactcgccgctagccaaccgcgcgcgcggttggctagaataaagaagttcggccccgtagctcagctggatagagcaactgacttctaatctgtaggtcgcgagttcgagtctcgccggggtcaccagacaaccccctactcccgcaagagatgtagggggttcatctatccagaggggcgcctgtaagcaaaaagtttgtgccccatttgtgccccataatttgcaaaaccaaattcgcaatttgcaaaccagattcgcaatcgcgcttagccccgccgcccatacttgcggcgcatccggtcgaagtcctcctcgctgccccatacgcggatggaggcgatgtcgcgcttgacctcctccttggccgcttggagcctctcacgctcccctggggtgaggcgggggtcctggagccggtcgatgatctggtccttgcggcgctccaggagggtcttgacttggaggtggcgggctgtggcctggtcgacgctgtcatagccatgccgcctcatgcttacatcctgcgggtcatcatatgccatgcgatcgaggctagcaggggggtgcaaggcttggctcaccgcaaaacgcgacacgcctgggcgagggtcttctcggtggcatctattactcccgcccgcgtcggatgatgttgtagatggttgataccgacaccccgtattgggtggagagctctttgacgctggcttgcttggcgttgtagagggactggatccgctgggcttcctgcgtggtgacccgggcgcgtcgtttcctaggccgcgcttgggttttcttgtgttcggcgggttggctgtccgtgtcctgcggggggtcggggcgtatgtcccatgtggcgctgggcaggatcctcagcccgctcgcgcggtcggtgaggatgcgtgggtcgcgcgaccatgagctcagggtccgttccatccggtcttgcgccggccccgtttccggcatggcggcgagcacggcgtgggccgtggccttgggcgtgtgccggtcggcccaggtgtcctcgggcatccagacctgccacaggccgtcgtcggtgtggccgcgcctgcggtacagggtcattcggctgacgccggtggcttgctcgatgctggccatgctcttgccttgcgcttcggcttgcgcgcataggtccatgagcagttgggagagcgtttggatgcggatcctggcgtccatcatgtcgggcctggggtcggggcctggcgctgacacggtggtggcgcgcgcgtggtcgcggaggcgtttgacgcttgatgcgctcttgccgtaggcgtgcgccagcgcggtggatggccagccttgctccagggccgtcctggccaggtggtccaggctttcggtttcctgggcgatggcccgcgccacgtccgttaaatacgacatgtcggggccgaggaccgctgcggagagatcctcgagcaaggcgcggcgtcggagggcggggatgacgccgttgtggggggcgaagggggagggttggtccggtgagggccaggcgctgatctcgctcgccgcttcggcggccgcatgcacggggtccagcctcccggagaggatgcggctcatggccgtgtccaaggtttgctcggcttcgtcggccgcgtcggcgcgcagggcgtcggcccgcgcgcggtggctgtgggtcatggagcccgccgccgtggccatgctcagccggtaggagcgccaggcgtcgcgcatggcgcccagccccgcgacggccttgtccagtacgcggccgccgaggccggtcagccagtcgggcaggatcggctcgctgtgggtctccaggtcgatgatggcgctggcttgcttgccgtaggtcatggacgccgtgcacaggcgccatcccaggtcgatgccggtggcgggcagcgcgcggcgggcccaggacagcgcggagggtcccgggccggccgagggcccgggcagggcccggccgatcatggacggcaggccttggcgcgagggggatttactgggcacgcaccggtgggcgcggtcgcgccgccagcagcccatcggctccaggccgtgcagggtcgtggggtcggtggcgtccccgtaggtgacggtcgcgccggtcaccccggcgggccctccggcgagcaggacgcggcgcgagggccaggccaggcagtcggccgggccggtggccgcgcggccggacacggggtccggcgacgggggcgcggtccgctcccatacgggcaggtcgccggggcgggcgcagtcgggcgaccagcccaggatcagcgtatggtacaggtccgggccctcaagccatgccatgtccatgctcccgcacaggcccatgacctggacgccgcgcggcgggtactccttgccgcgcttggcggtggcgctgcccagggcggcgggtttgatgcccgccgtgtcccacgcttggatggcgagcagcgccgccacggcccgcgcggggtccaccggcgcgtccgatgcggcccgcgcgccgaaaagcggcgggctttccacggggtccgcctcgcgcagggggaccgggcccgccgccgtggccaggccgggcgtctggaggaagggccggtccttgtcgaagaggtcgaaccgcccggcccaccggtccaggtaggcgtccacttgggcggggtcgaacccgtcccgcgcgtacaggcccagccatgcgtcccgcccgtcggcggacccgccgggcgccgggaggatccggtaggtcaacgccaggaggagccgcagcgtggggatccggtattcggccctgggctcggccagccgcaccctcccggcctcatgcaatgtttggcggatgccccactcatgggacccgccccgcgcgtcgatgacgggtatccaaggctcttcgagcagatcgtatccgggcatcagtcctccgccccgaggatctccaggacggcgtccctgtccaggcccgacgcctgggcgagctccctgacgctcatggagtcctcggccgcgtggcgcagggcccgcctcaaatcggagtcgctgtatatcatccaggagaggtcgccgtcctcgtcgcgcacccggtccaccagcttcatgacctgggcggccgccgtttcgatccggtcccggtcttggtcgaagagcgtttcgtcgggctccgagatcatgtattcgatgcaataggcctggtcgtcgctgacgtcggattcgtcggccgtcaggccgtcgacgcgcgccgcctgccgttggaactcctttgacatgctcagcgcggcggatggcacgaggtcgtacttgtccgccatgcgctgggccaactcctctatggtcataatgactcccctctttggatggtccactaccctacatcgactattgtaccacaatgagcgcccaatgtgtgcggaatttagaaaaatgttaccggtccccgggcccatactcgatggccgccccggtccgcgcggcgacgcgcttggctatggcccgtgaccaggcggcgggcatgccgtcctccctggccatgtcggtcctgggcaccaggagcacgtcgtcgccccggtccgcgccgtcttcgaccagcaggtcggcctgggcttccagggcctcgaggtcggaggcgatgccgtcgggtatcctccggtcgccacgctcccaccgctgcacgctctgcctcaggacgccccacctgtcggcgagccattcaagcgggaggtggagcgactcccgcgtggccttgaactcagctggcgtcataagcgcgccccttcctccttgcgtcctcttgcgccggggggcggctcggcccgcgagccgacgccgcccccgcgcggcccgcttaccgcttgccggagacgtcgtgccgggcgaggacctcgtaaacgtccaccccgcgcgcggcctcggccacggcctcgtcgtcgatctccgcgtcggcgtcgcagacggcgacgcctgacctggacaccgtcaggcccaaggggttgacgacctggttgacgcggtccatgtagtcgtccagcgcggcgtccaggtcgtagtcgccggcgtcggcgccggcggcgttctcgaggatccagtccatccccggggcctcggcgctgacgatcgaagcgaagccgtccgtgtactcggtcttggtggtcatgatctgagccttcctcgctcggcggtcgggccttatgctgaccgctcatgactaccatgataccaaactggatgcatgacgcaaccggtatctattccgggcgtgtcgcaaggcggggaggggggcgccgccatccccggagatccgtggcgcgcaaggagaccgctggcgtcctatgcgggctgccgtctacggcccgccgagctcataagagcatcatctacgatgcagtctccccactgtcgctaaacgcgaaaagcgcccccgctctccgattaccggaggcgggggcgcttgggttatatggtcgtctgcttgctgtagctggctttggcttggctggcgccgatgcaggccgcgatgagcaggccaagcgcgttgagcgtggtcacgatcgcgtccacgtgcggcagtcccagcgcgggtcccgccgtgccaacgaagacggccagcgcgggcaggaggaccagggccgcccatttgagcgtctggtacaccttgccgggcagcaagtaacccttaccttggtcgggttgcgtcgtgtcgggcatgattatcacctccttcagtacgagaggacctcgcccgggtagatgaggcccgggtcgccggaccggtagccgtgcaactggccctgcggtacgccgagcctggccgcgatgccggagagcgtgtccccccggcgcacggtcacggacctgcctccagcgccgccgccaccggtggagagcctctgccctgggtggatcacgtacggcgcgtggatgccgttgagcctggccacggtcggccaggagccgccgaacacggcgctcaggcagtcgcctgggcgcaccacgtacacgcccgaccccgtgccgccgcccgtattaccgcgcagccgctcattaaccgcggccatgacctcgttgtagcggttgcccaggagggcgtgccgctgcgggtcgttgccgtagtcgccgcggatgacagccgaggcgatgctggcagcatcgccgaccggcgcgccctgctggggcgtgagcgacggggcgaccgggttcggccgggtgcctataggcgcgttcgcgtacttggcccaggtgcccgcgtccccgtaccaccagttgacgtccacggcggtccccacgccaggcacatgccccgaggaggagtactgccaggccgccgcgaacggccagggggccaccgagtagggtggggcgcccgggtcgcgcagccgctcccccgcgtacccgcgcggatacccggccacccacagcccgtaatccgcgcccgccaccgcgcgccaatccccggcgctgattgtggacgcggacatgtagatgatcggcttaaccccccaataggaggccacccggtccaaccagcgcttcgcccactccgtgtcaccacgatgggatgcgggcggctcccaatccaaaaacgggatcacccccgcatgcaccagaccacgcgcattcgactgggcattaaagaagtcggcctcagcctccggcgaattaccgtattcgggccgcgcgtacccgtaagcgccgatacgcaagcccgcggcgcggttggcttggagctgacagtccgcggcggggttcacgtaattgacgccctcggtgatcttcgtgatcgagaaagacgcccccgagtttttggcggcctgcgcgttataacaaccctgccagctggaattgtcgaagccggcgtccgcgtgggcgacaccagggacaagcatggccactaccgccgccacccccacgccgatacgagcataccggggcttggcgcgcgcgtgacgcgcatgagaaaaacgcatacaccctcctttgtgtaggcatgaaaaaagccacccgggatgggtggcaaaggcaattgacgggccgatcagtccacggatggcagggcttttagctcctcgtacagcttggtccccgtcccgttgcctcccagaaggtggtaggcgcggtacacgcgttcggcctcctccatgaccgccaccgggatatggccgagcggcacgtattcggcgtggatctccagcagctcggcccgcaggagcgtacgaaggcccgcctccatggcctggtccttggcctcctccttgcggtggcttttcagcagccatccgcacatgccgccgataccggtcaagagcatgggaatcacggcctctaccagggtcatcagcacgtcagacactcggaagcccctagcattcggtcagaaacacgtaccgggcgaaccacccgctgacctgcgggtcggtgtagcacaaatacacatcaccgccggacacctgacagtcgccgaaatacttgaaatacacggtgatctgataaacgccgtccggcagccagaaccggcgcgaagccgaataattatccgtctgccccccgggagtcgcgctgctgctgaccacatgcgtggcgatgttttcaccgtttttgcggatcacggcgagcaggaaaccctcgcccgggcccgtgatacgctcgcccatgtcaagcacataccagcggccctgaccgggggatcgcacggtcaaagacgcagtgttctccgtataccaggtccctcccggatagcctggcctgcctgtccaggaagacacccactggtagacgcgacggtccggcgcgtagatcgacctgccatccagggcgacatccccttcaatcccaacaatctgacggcctacgatatccaccctgtcggccgtcaggccgacattgttgcgcccctgctggcccctcacgatggagatctccggctgctgcgtgctggtgcccatcatcagccggctgaccagcccgtcctcgtcatggtcgccccagatcagccagtacgggtgcgtcgggtcatcccctatgccctgcaggccgcccgtggtggtcccttggatcagggtctggctcaactggatgcggtcgccgccgcccgcggtctgcaagccgcccaccgcctgcacaccgttcccggacgccttgaacagggttttcccgtccacgcccttggaccagaaacccgacgagtcgaagcccaccagcccatccggcgtactgaactggcccgacctgatgatgcccgcgcagatcaggccaatgaccgccgcgtccacctgcacatcacgagccgccagctgatccaggtagacggccaccgggatcggcacccacgcatccccgtcccaccaccattcggccgctacggcgggacgctcgccctccccatagcgcagccacaaatccccccgatgcttgccagcaccctcagggtcggtggccgccttggtgaccaggatgcccaagctctccgggtcgatgtcagcgcccgacaccgtcacacgctccggcccccaggccgacgaaccgttaggcgccggactgccatcctgcgcgtgcgcgtcatcccacgccaccaccttcacctcatgcacgctgcccggctcatacgggcccaacgggtacacgcccttagccagcgccctgcccgcctccaggccatccacgatcagcgacaaatggtcgaagtccgggggcacgccaccctccaaccccccatcccaagccaccaggatcatgcccgcgccagaccccaccgtcacacccgtcggcctgcccgggggggtcgtatcccccacccaatgcaccacaccctcaggcccggcccccggcccctggatcgtcttggtcccgtccacgttatgccaggtgccggtcccggtcgccccggtctgctgccgggtcgcgatgtccaaggccgaccccgccgccagagccacgtcctcaaacgcggtgcggcggatgatgctgggatggtataccacgattaatcactccttaaaaatcattggtacgggtcggccatcacgtccagcacgacctggcccttatcggtttggtcgccggacaggcgcatgatccgggtcccgtactcaccatccggcaaggtggggaagccctgcaagtgcaggacgcagcgacgccccggccgcaagccggacggcgtatgcaaaggggcgcccgactcgtcatggtcgttgaaatggacggtgccgctgacctggatgagcttgcgcctgccgccctccaagcgggactgggcgtgccgtttaagcacgtccagattgtcggtatcggtgtccgagtagacgccctcgcgcaggatgggcgggtccatgccggacatgaccggccccaggtcctcggccagcgcggtcagcacgctctcatccgacccggcgccggtcgcgtaccagcgttggatgggcgaggcgtgggacacgctcacgtcttccaaatcgccgcccccggggaagcatgacaagtggacgggagccgcgtcctcgtgcaggtacgcgtccgcgtccgagcccgccaagaagcggcagcgcacatgctgcccgtcctccgtccagtacggttcgaaatcacaatccgggccgccttgcaggttgctgatgtcctcgatcagcttgcgggcgcccacgttctgcgcgttccacgccttgtactcggtcttctgatggtttccgcgctcccccaggtaggtccagtctatgggcagcgtgccgccctgcttgcgctcggtggcccacgcgccgatctccgactggatgccccggtaggacaacccctgcacgccgatgatgtcggtgctgcgcccgtcctggtaggcgccgtcgcggatcacgtaccggtcagccagcaaagccataggcgacaccaggccgaacgtcgtgtccagctggtggtcctcctggtccccgatcacgccccacagcaatgggtcgcccaagtcgctcggctcgtcggagcccacccacgcggtgcacaaggcgcgccgggtcgggtccagcagcaggctgcgatcagccggcgtgcgcgccgggagagccgaccacggcagcgtcaaaccgctctcatcaccactgcccgcgcccttatccgccggccccgtcgtcgataggctgaaatccccgatcgccatgtcccaggagaagctggggatgtcgatgaggcagacgatccgcccatcgcgcgcgtcgcaaatccaatgccgccaactcaccgggcgaccccctcgtcaataacctccacagtacgcaggccgcgccaagtgaaccgtggccgccccagattgggtttggccatcacatccaccctgtgcgggcggcctccctccaggaccatgcgccactccacggactgcctggcccacacatgcgccaccaggcactcgtccaaaccatcacccatgtcctgatcgtcaaccacgggcattgcataaaagctgcccacctgctcgccatccacgctcgcccgccacgtgaacttgaccgtgaccagccgatccgtggccagcatcatcgtctcagcgggagcctgcgaccaccatttggtgctccaatcctgcaagacgctggacgtgttgctcccgtagccgatccgccccatcttcgccccgtaggggatcgcgtaatccacgctccccatgggcgacgcggagatcgtggcggacgcgcccgccggcatcgtcatgtccctcagccgcaaccccccggccggcactaccgggtgcgcaggcgacgcggacggcgtgccctgcgccacatgcaaggacacctgcccgccggcccgcgtatccgccagcaaatacaccgtgtcgatgcgcgggtacgcgccgtcacccgccgtcaccgcctccagggtcagcccgccgggccagtacgcctccaccgacccgtccgacccgccagtcgagcacaccgccaccccggccgacgcctggtaccgcaagcccgcggcccccgacacctccaagccggccaccacgcccgggttctcccaatgcgcgccaatgacgcgccggtgggtcaaagcgtccatgcccacgccgtccgcgtcctgggccacgcccaaagctgtcaccataagagcctcctcacagccaaataagtaatcagatgtaggtgtcccgcgtctgcgcgtccacccagccgccgcccgcgctcagacagcgcagcatgatgtccccacccggctcgatccgggggaagccacgacgcgtgaggccacggctcacatccacgccacccatgctcgcggtccgcgaccggcagtccagcaccaggggcacgccaggccacacacggccacgccactccaaagactcgccaccatcccacacgagcagcaccccatcaggccaatcacccgacgcggtcaacaccggatacgcacgagccgtgccacgattacgcaacagcgcctgactctgatccaccgacgccgccccataatccagcggatacgccagccccttgccgtcagggccgtaagagaggccgccagccgacacgctcggagccatgagctgcactgactgcgcatcccaagacaagcgctcaggacgcgggcagaccagggtcaaggtgccttccaggagctgccgagaccaattcgacccgtattcgctgtgcaggtatccctccacatacgtgtcctgcccgtcatcaatcacgcggaatttgacgattttgcccatcatcgagttaagacgcgaagccaagccgatgatcgttgatcgtgtcatcccgaccgcgtcaagatggatagtgactgtcctggctgcgtatgtaatgtccgggtttgacacatcatgggcgccgttcccccaagccctttccgtcaggctgagcttcaccggaggcgtggagagccacccctcgacgccgtcctttgcgatcatgatgcctgtcttttcgggggggctggccaatccgctgtagaagcggatgtcgttgtcatcgcaatacaggtgcgctgatgcctcgaacatgctcatgccatccccctcaaagccatcctcgcggccgatgccatctgcctgcccatgattgttccttccacgaacgggtctttgacgccgttgttggtgatgttcacgggctggatcacggtgggagacaccacggtggacgttgactgttccactttcccggtccggttcatcctgtccaaagcggcaagcccgatcctcttcgccgcccatgccctgaccacatactcctggtccgacagcaaagccgggatcgaatcactcgtagtggttccagggccgcgtaccagaccgtaaggcccgccgcctgccgagaaccctacagggccaccattcgcgcggctaacagcgcctccggcgaatttccctgatggtttcccggtgaagtaggtcacgacttccccagggatccgcttgaaccaatccaggatgttctgcaccacgccactcgcatggtcgtgagcgttcaaatcggtatccttttgcctcggcacgctcttaatggcattatccacgtcgccgatgttcttgatcgccccggagttgaaggcgttcatcacggtgtcctttgtcgcaggcgtgagattgagagtattgagatactgctcgacctggcctttgctcagcggcgcgttctggctgatgttcgtcccgacattcgagggtatgagcccaagctgatccgcatactgctcggcctgctccttgctcatgccgcactgctgggccgcgtccaccatggcttgacgtgcctggtagatgttgttcctggcatcctgtgacgcctgtccgagattgccggtcgcttgtccctgttgcatcacggcagcggcagtagcgatggactgatccgccatgttctgcatggcctgccggttcagctgcccggactgggtgttggcgtcaaggctaccgccgttggctttgacggtcgtcgatagtcccgacaatttgttgttgaggtcctgctgtatgcggctcaggttttccgcgctcccggccatctggttctgctgccagactgcgtcgttgtaagcgtggttcatttgcgcgagcttgcgtacaccctcctcgactacgccattatgcttacttccttgccccgtgctctgctctagagactgtacatatgagtcgatggagcctttgtctccctcaatggcccctcggaaggtctgcatgctgaccccggctccgctcagctcctccttgaaggagccgtacccggacctgaatttctggaaccagccccagtccatgtctgtgcccttggtcgctgcggtgtcgacgaagtcggagtaggcagtctgtccttgctgcagagcagactccaaatccgttgtccgatctttcgctttttccgcgtggtccgcccacagcatgaccccgccgactgccgccgcaattccagcggcggcggcccaaccaccagggccgagtccgccaagcgggccaagcaagccggatactcctccgccggcctttccggctttcgaccccatttcctcggaactcttggccagccccgagacattaggggctgctaaagaggcagatttgccgataccggcgaagtcccctgccaagggtgccaggccagcgctggaagatacacgcgccgagacgaaatccgaaaggatgccgcctactgatttgactcctttgcccagtccaccgactgctttcaaagccagaccgatcggggcctctatggctttgatctgcctgccgaagaacatactggcgccgatggctccctgtatgggcgctgggagcgaggagaaggccttgacaagggtccccatgatggtgatggtcggtgatagggcgttcagtgccagcgtcaccgattccacacccttggtagccaggtcaagaccaggcttggcgcctttcatgcctccgccgaacgggtgcatctccttggtagtgccggtaatctgttcacggacgcgcttaagagcgtcctggaagcgttcgacgaccttcgggtccatgcccttgaaaccgtcggtgaaggatttagagatggtgccggacttgaggaagtcgcccaggcccttgacgctgtcgcggacatgtttgaccgtgctctctatgccgtgccgcgcggaatcgggcacatggaaagcctgcgcgaaggcgccggacaccctgccgtcgcgtaggagggagacggtccctcctacggcattcgggagccatttgaagaaactgtcaagcttgccgttgatcttgtccaccacgtcgatgcccatatcgccgagggccccaatggcatcgatgaagccgccccctatggtggtcttgatggcggacagttgatgctgcatgatgatgtacttgccgtatggggtggccgccatcgctttgttcacgccgccgaagttctgctccaggactttggcgagggtcgcggccctctcctcctgcgagccgtgggctaggagctttttctggttctcgtcgagggtgacgccgtacctgctcaaggcgccgacgttgccggtcatgaccttgcctaccaggtttgacagctgtacgccgtcctcggtcgtggcattgtagcccttcgtgttggcgatgaggtcagcaagagctggcgtgagggtcttgacgctttgggaggagagcatgaaagtaccgagctgggcctgtgacgctttcagcgtccctgcgctgatgatgcccgtcctgccgagctccttgttgtaagcgagtaacgcctgggtttggtcctgcgcccagtggttgttgcttgcgatttgctggaatttggctgtcgtgccgctgatttcgttgtaggcgtctatagcggtgcgcccgtagttgacaatccccctcgcaccgaaagccaggagagacccaatggcgaccgtgctggccttgacgtggccgaccactccctgataagccgcccccagtccattaacggtggcaccggccttatcgagcctttgtgcgttcaatccctggatcgcggacctgatgcgggtcaccgccgactcgaacgggccgaccttgggtgcttcgatggtggcctgtttgacgtcagcgacagcctttttggcgtccttcagccgtttctcggctgctgtcagggagtccgaggtggactcttctttgcgtttggcgctggcaagccgttccgacgcgctgacggcctgtacgcttccctctccgctcttcttcacggcttcggcgtactgggcttcggcgacacgcaccttgcctgccgcatcttgctgcttgagccgcgccgcgctcatggctctagcggccgaggccacctcggattcgagtttcctcaaacccggggtggccatgtccttggaggcgcccgtgaaggcgtttttcatgtccctgcccagactggagccagtcttcgaccctaccccgttgaaggccttgccgaagatgccggagccctcatgtccggctgcctgcatctccttggaaacggccgctctgaagcccgtcatcacggggaagatgctgacgtgccctgatcctacttccgaccctccggccatgtggtcctcctagtacaggtccgcgaacagcgggttgactttgttcactgcctccgcgctccgatcatcgggttcgtgattcggccggggggcttctggttcctcttgcttgaccggtgacatgccaggggctatggtttgcaggatcgccagatccgtcattgatgctgggtatgtgagtccaagagcctgcgcccctgtcagggttgccgggtcggattcgatggatgacaggagcgctatggcgtccccgtatctcagtctcccgccgaggtctgctgcgaggctccatccgcatcgtgcgaagtcggcgctgatgctggtacgctcccgttggacgcgggcgcagaaggctcgtattttcccattgacgccatatgcacctcctcgatcacctgaccgtacttgtccccgattgcaaggagggatgaggacatctcattgtcgatctgttgcttctttccggggttggctttctgaagcatggcgatgatctggtccagtggagacttgtcgaggtccttggactgttcgtcaagctgtcttggggtgaggtcgagcggcaaaagatattgggtacccgtgattgtcctgatgaagaggttggggaacttgatgatgtatttgttcgcaagctggcgtccggcctggcgtatgtcgcgctgccagtcttggtcggtgtacgactcgaagtcgaggtccatatcggcttcttgcgcggtggtcttggtttctgctgccatgcttgatttctcctactttgtgcgggtgcctgctgagtggtatgaaggggttccccgtgccgtcaagcaggcgaaacggcacggggaggtactggtgatgctgatgggtcagctcgtcttggggccgctgttgggggtcggggtttggttcccactgttcggctgctccccatacacgcagtcgatccatgcgttaccgtcgtaggctgggtcgcgctgccaggtgaaggtgacagctttgcctttcaccgtgccacgctcggcctggtcaggcttgttctcggtgacttggacgatgccggcgcgtcggtagacggtgccgttctttcgcggctcctcgtagtaagcgcaccacttacggtccggggtgagcgtatccacatggtagacaccgttctcgtccggctccgtcccgtagcacaggagccgcgtgttagggttgtcctcggcgagtgagacggctgtggtcaggtccgggctcttggacagcgagtagccctcctggaagaactcagtagcatctccctttccggactcgtcggccggcccgccatcctgcttaatcaggccgccggtgaaatacgcggcgggcagttgcactttcgccaccttgatgccaatgtcctcgggtttgagaatgttccccggcgcgtagggggcgaagcttatcgcgcctcccttcggcaccggcactgcattcaggtcattgccttggctgtcttttgccatgcaatctctcctaactatggtgaaggccaccgtctggtggcctctggcttggttacttatcgcctgtcactgctgttcgccggtgacggagtattcgatggtcatgtagcgtcttgccacatcttgatcgtcctgcaccgcatatgggccgttgcatccttcgtcaaggaccgctgctatcggcgacccgggagcgtccgtgacggcgtcatcggtcagatgggcgtacacgagacgtgccagatcattggcaggcttgtcatatgatttcgacccagccaggacgctcacccccacggaccggtcccatgtgaccaggctggtcctggtgccggagtcgtcgcgtatgactacgaggggtttgtccagcggagcgtgcagttcctgcggttctttgttccttacactgatattagggatgcgctcgcgaagccatcccgtgaggaaatcttcgatatccggcggcaggtagatgctcatttggccttcttcagcgcgcgggcgagattccccgtcttggattcgaccaggagcgtcttagggtcgctgcccacgaccatgtaggtgtcgcgtgaggcgtgtgccaccttctcgatgtgtagtccctccttgtactggcccggatgtcttcccggcttcttgtagacagggttggacgggtctcccactggcgctgaggctttagctgcgtcaagggccttctgcgctttctgcctgcacatctcctcggcgccggcggaacgcatgatgctcttgaagaaatcctcgttgaagtgcatagtgacgttgtctttgctcatcctatgacctcctgcaggtcgcatacgagtgtcggttgccacccggtgaaggggttccggtcggcatgcgggtagccctgcacatcccatattctgccgtcctcggctttgatacggtcaccgcgttgcacgtcggagtccgggtcgtccaggatcagctctgccgtggagattgcctcgtccctgactgggtccggctgttcgatgcttgcttttgatgccagggtcccgtagacggccctggtgtccgcctggccccatccaccggacaccaggtggtcagggtcgtaggggtcggggacggttccgcgtctcagcctggtgtaggcctgccggtggcccatcccgtccggaccgcctcctgtatagtctgccgcggttcccatcatgccgtccatttcagcctgtagggttccagcgcgtctttctcgatttgcaggagcggagtgctcaagggcgccccgcctgccgtcaggtaggacacggacgagccgttgacgctttggctggccaccacccctggccctgtggccgcccggttagcgagtttgaggataattgacaccacgtcgggcacctcatccacttcatacccgctgctcatcgtcacgatgacggagcggaaacggtcggggaagctcccggagcgaagactgaccatgccagtttggctccagtccacttcaccggtcacatcacggccgtccacggtgatgcgggacaggccggtgacgtgcagggaggggagcatgagcgtgcggccgccttcggcgtccagggtgagggtctgctccacgttaggggctatatgccacccgcagtacgagcggaccgaggcctgggctgctttcagccacagattgggccctacctcggaatcagggctgacgatgtcgcctattccaggctgccgtgcgtccatgctccacctcgcttcccgactacttggaccgggcggccttgccgagggtcaccttgacgaaggccttggggtacttgacttgcaagcccaccctctccttgaggcgaatggcttgtttgtcgttgatgaagaagtccgcgtgtgaatcagtggacttgatgtcgatgccacctttgcgcagcaccttgccgccggctttgaaagcgccgacgatggcggttcctggggtcacagcctcggtgaccacggtgcgcaagccccagatgggcgggtcctgcatgacgccgccgttaccgtactggccggtgaagtaaccgccgccgaagtactgtccgttactgtccttggacaggcgaatggcctcatagtcggtagggttgatgacgatgccgtccgggttgaacccggtgtcatgactgatcagcctacggcatgcgaacagtctgtctgcatcggagtcgtccccctgccccagggtctggatgccgcgcatgagcagacctttgaggttcgggtcattgccgtcgccgttgagtagctggttctcctcctccaatccgagggagtattgggcggcgtcggtaatctcgccctgcagccatggcaggtcctccaccatgtcgtcggatacgccgaaccagacagcaatctctccaagggagtccgtctgccaggtggggtcggggaagtgggcctgcgctttggtcccgccctccttgacggtcttcgccccgccttcaagctccccgtacaccggatacttgagggcggaccctgaaagggcgccctgcgcgaacaggtcggccaccacgaggggcctgcggtaagggctgacgccctcctggtccacttgcgtgacgaaaggcccgaacgcaccgtcggagcctccgaccatttgcgtgtcagtaggtgccttgaaggacacctccatgccggctttgaacgcctgccgggcttttatgcccttagcctgcaagttcttaataaagaactctccaggcgtgcgcgacttagccgcagagccaccgtcgttgcctgttggcgccgggtcggacgatgacagcccgtcgatgctgtgcaggagctgcgcgctttcgtcagctttcttgatttggtggtccaggtcggacaccttttcgaggaggtccttgacggctttggtgccgtcctcgtcgagggcatccccggttttgagctgctgctggtaggctttcagcttttcgatggcttcggcccgcttttccttgagtgtggccatgtcaggctacctcgcttccttcgcccgtcagggcgatgtcgatggcaagcttgagcgcttggctgtccgcatccggcttccgttcctcggccttggccctgtggggctcctcggtcttgacctggccagcgtccgctttcgcgtcttcgctttggttgttactgtcctggtcaggagcggcctgagccaggaaatccttgattttggtcgcggacttgttcagcgagtcggcgacctcctgcagcatcgaggcgttcttggcgctaagcacacgccccgctttcatccctgccgctttgatgcccacgattgacgtgtcctgattggctcccacgggcacgaaactggcttcgtacacgtcgagttttcgcagttcgttggcctcggtgccgtcgtcaagctctaccgtcccctcgtcgagcacgtcgaaggcgaaacttaactgagacaggcggccatccttgatgagccggtacacttgggcggctttgggcgagtccatgtcgaagcggcctttgatccaccagccgtgatcgtcctcccccatgtcctccactccggccacgttgtagtcggggtcgtccatgcggtgcccgtacatgacaggcaaggtcttgccggaatccttccacgctttgatggtgtcggcgaaggcgcctttggcgaccacatccccataggcgtccggcatccgggtaaaggtgctggggtaggctttgaattcgccttcccccagcgccttatcatcaccggtggttttcacctggcaggttcgttctttaatctgcataatcgctctccttgaattcgctttcggcctctctggtcctccctagtgcggttatgcctgccgtgtacaggtcaagccccgccttgacgaccaggtcggactgcagctcgtcgctccacttgcgccagtcgatgtcccccagactcttgcccgcacctagcctggacttcacggacttgcggagcctgtccttccactcgacgatgactgccttggcggggtccgactggtcaggcgcccttgccggctccccgccatcctgcgggcttgcctgccctccctgagtgacgttcaagggcaccacaaggctgtctccgccctccattccgggaaggttctgcgtagcccgggcctcgttgggggtgatccagggagccccgaccgatgtgcttaggacgctggcctgctcctcgaaatcgccggagagcttgctgcggatgtcgaattccacgtagttgtcctcgtccgtcccgaccatcggcgccaggaaggtgttgattcggtcctcgatcatgcggatcgtcggccccagtgtctccgagtagagcatcttgcggaattccctggtgttggaaaagttcgcattatcaagcacacccaccatgaccgggttgacgtggtacacctgggcgacggtctgcaggctgagcttggtcacctccacgaactcgtcctcgcgggctgagaaaccgaccttgttcatggtgatgccgtcttcaagcagtggggtggacccggcattgacgcccttgtcctggaaggacttccaagattccttgaaccgtttccgatcctcttccccccattcgggggcgtccttcggcctggacaggtagacgccgatgcgtcctccgcgctgccagctttgcgtccgatatgaccaagcctggatttgctcgttgatgacatccttaagtgccttcaccgggctcaccccggctgaaggatcgttggggttccatccgtggaaggcgaccaccgacgcggcgggtatgtccacatgcccctgcccatacccggtgcccacgcggtagtatccgggtgcgaaggcgtttccctcgcctttggcccttacccatgatggcgggatgggctggatggtccacgcgccgaaacggtccacatcacggttaggctcctgggttactagccagtaggcgttgtcgtagagggccaggtccgagaccagctgtcggatcagctcataccctgtctgtgtggcgttcggctgctggagcaggttgataagcacgtcatccgtcaccctggggcggtccgtgtccgacgtcctgtgatactccttcaaccccacctgggccgtgttgtcggcgaggaagctgatgacggtgcgcaggtgcggctgggtcttgtacagctcggactcgctttgcccctggatatgggtaagagcgtcctccaggttgaaggagatggaatactccggttggaagattgacctgatctggctccagatggacactggtcacctccctctcgtcaaaggaccatcagcccatggtccgcgtacgctgatgccgtgttcttcccctgctcagcctcgaacatctcaaggccgtataaagcgttcgtctccgctatcaggccggaaatgtcaagcatcgaattcttccggtcccaaatatccacatcaccaagcttgcgggccactgcagcgctcacagcctggtcgattgccggctgcgggagatgccggagcttctcctcgcgtgtccggtcgcggaattgcccggccgaggcgccaagcctagggccttcgatgcggtcaacctgccatccagcgtcggcaagagggtctatcaggtccgaggccctgcaccccttcccctggatggcgacctcgctggctcctgtgaccgttctgatccggtccatgagtttgggcacccacatcatgccgtcacgcctggcgaccacctccacatgagggagcccatcatcacggtatcctgccgcggctatccatgtggtatcgccgtccggcgtggtgtccacccccaggacgatgcgcgacccgtccgctatcgcggatttcgaatcagtgcccttctcccatttggaggggtccagataggtttccacgtctgcggtcacccattggcacagcacctcagtccggtatcctgcttcagtcatcccctgcgcctccgacgcgaccgaatccaccgtcagacccccgaaaccgattgacggattcgcttgcaggattccgtcacggtcatccagggcgcagccatcaggagcggaccattcgaacaggccgatcgtcgcatcctccgggtgctcgtcgatatgggccgacatggtctcgccagccgccaaagcggcatcgcatcgcctgatctgctccatgcctgcttcacgctgcttcttcagcaccacagccgtgccgtcacccgcattgctgataccccacagctgaccgctccagaagcttttcgtcgtctggctcaccgcgttccacgccgcccaggtggactgttcacgtagctcatccattaataccctggcggcaggcttcccgcgggcgcttttagcggcgcgaatctcatacacggccagatctttcgccttgatgtactccttaccgttcgtatcggagactttcaaagtgttgtcttgcaaggcggggacagcgagcgtgccctcctcctcagtgtcaggctctgggtcactccagagcttcacctggttccaaggttcgcgtgcgatatccaagttttgcgcggtgcccacgattttgaatttcactggaggcacccgttccgggtgacgctgcgagtccacatggagccaccagtcggcaaggacactggccagcatggttttgccgttctggcgtgccaccaggacaatgacgatgcgatagcggtagcttccatcctccctgagctccagcgcgtggatgagcagccattgctgccaaggtctgagactgatatggagcaccgtttcggcgtagtcgatgacttcgtaccctagtgaggtctttggcgtgagttcgcggagcggtttactccagattcgcggctcagtggcgccgaaaacggctttttcagccattcacgacctcctaagatcgttgttcatgccttatgacgctgccgaaaagcagtgagatcatccactgagaccttccttggctttctttcctccgctttcaccgtttctgcggtcaatccgagcgcctggaggtatttcaggaaggttgggatggtcacattgtcgatttttccgtcctcgttttcgaatcccgcttcgcacagcatgtcgattcgcctggccagcacccttgcggccgacactaaggcagagtgcttcgcggtaagttgcccggagctgttcttgatggatctttccaatgcgtcagacacgttcaggagctcaaatttcgctgccatgatgcccctcctcttataccgcgcgcgaccccctgtacaacgctcggggggaggggagtattggagcgcgggaggtaggccgctcagggcggtttccagcgattcgaacgcccctaccccccgtgtcatctattacttgtgtgcatgattgcttagtaccatgtgcgtgaatgcatgcctagggtgagtttgggtgggtcggctcctcgtaggatgttgcaaatgcggtgggcgtggcggaagttgcctgggtcgtattgcaggctcgggtccacggagaccggcacgtagtggtctagctcatggctttcgtccgtgctgcccggctttacggtgtagtcgatgggcaggtcgcacagccagcatggcgcgttctctttcttcccctgctcgaagaaccgctggcgcgctttttggaaggctcgcgtgctgactcttgctcttgtcatgcatggcctccgctagtctggaatgatgacgctatgaggcgtcggaatggagagaattatgggtaagggtaggacggccgcttgtgtgctcttgtgtggcggtttgcttggtttgggcggatgtggcacggtgcatgacgtgaacaccactagcactggtgaggggtcgtgctccaccgccaacgtggacatatcgaaggctggcctcaacgagggcaagcttgccttcacatcatcccaggcgcctaactcctccatcaaggtggatatcgctaccgacaaggggaaggccagcgtcatcgggtcgatacccacgtccgacagcggagtgaaaggcgtcgacgcgaggggcgaatccgtcagcctagacgatgcaacgtccagttccaagcctttaccgtctggcggtgccgtcatgaccaccaaagccaatatcagcaaacttggcctggcggggtctctacagtcactcactttcacaaggctcgacgcgaatacaggatcaccgaccggcgagggctgcaccatccacatcaagtaaacaggccttcggtgcggtccacttgcatgccttggcccgccatcgtgtcggctatgcgcgtgagctggcgctcgatgccttgcagttggttggtttgcggtggctgcatacggaggccgtccacgcaaggatgggtgcccgcaggggaagaaaggttgaaagaccctgcgggcgggtatgggtgagggccgatggcatggagccaccgaccctcgggtttatttatcgtcgggccccgtgccggctgacgacgaccggcaggactcgaggccttcagtttgcgactattattgagtccatgtgccaatatgatcctgaatgcccggtgcatcgtcatcgcccggggacaacgtgcccggtggtgtatcgcaagcgtatggctgtcatccgtgagcaggagcggcgtgagcagcagaggcaggacaggatcgcggtgttggtggcccttgtcgtggtggtggtgatgtttgtgatcggctatgtcgtcgcgtctgtcgtggccccggattttgtggcacaggtaagacaggcgctgggtatctaatagcagagcgtcgctgctttcggccagtacgcggaaggccggtggcggagcatgcaatttgcgggcttaatcacaaagggccggacctctcggcccgacccttacactaaaagcaactgtattcaaaatagcgtgtcattaggacatttgcaagtcaggagaggcgtttcggccctgggtggacgccttgcgcgcagtccagcagctcggacaggtcgcactcgtacacgccacgacccaccttgcgcgagcggccgagccgtccacggcgcagccagttacgcacatcctgccctttgactggcacgcctgcgttggctttgacccatgacgcgatcctggcgggcgtgccggtgatggtcctgccctcgaaacgccgcctgcgcgcctctgtgagggctttgacgctccatgtggacccgcattcggggcagaccaccgtcggctcccctggcgccccgctcagggccgttttgcaagcggggttgaggcagtgcccgtacacgatgcgctcgcctggcgtggacaggcgctcgctgacctggcgtaaggcgtcggccaggtcacggtagtcgcggccgctgttgggagcgtcccacaaccgcccttgacggttggtcagctcgcgcaatagtttttgcgcgcggcctccccacaagccgatgtcgccggccacgtcctggatcacgtcctccacctggtcgtacaggtcggcggcgctcaaatccatgggcgtgggggcgaacgcggggcgcgctcccccgcccccgccgccgagcctgaccttgcggtcggccacggccctaagctcgtacatcccagtgcgcagcccgcgcaggatgcgcgccaaatcatgccgatgctcctcgcacagggggccgcgcggacccctgatgcacaccgggcaggtcatgcattgactcatacgctctcttctcttggctggtagtcgcacaatgtggggaaatagtcgtcctcccactgcgcgatgtcgtggtaatgggtggcgctggtgctgatggcgctgcggatggcgtggacgcgcagccatcgccggtcaaggtgacctccgtacgatgcggcgtaggcgccatgcaccggcaagtcacgggccgccagataggcgaagacttgctcggcgctccatcggcctatggggcggcaggtttttgtggagctgagcccgcgggaacgtatgctcatgcgtctcatggccgattcgtcagctcgtactccggtgatgtgcggatcatggatttgttcgccgagcatgtcttggtggcgttctttgacatgccgcatgtagtcttcccatcctggctcccctcgccgggggttccgtggaaggccgggcctttcggcgtagacgcatcctggatgcgcgcggaggaaggcgtcgcgcacctggaagctgggttccgtttcgtagcatgtgccgtcctcccgtaccgctggcacccagatgatgggtatcgccgggtctgccatccatgtaaggtgggcgaccaccaccgagtccttgccccagctgacgttggttatgcagtccgggtgtagttcatggaatttgcggatttcttggattgctttgcgttccaggggttccatgagcgcacctatggcttggtcgtatctgccgtacccccgccagacttcgaggtcggcgggggtcagggtgctcatgcctttcagcatgtgaccgtcctgtcatccgaccagtacggcggtcggaatcgtcctgtttgcccttgttgcggcattggtctgtccttccatgcttctgggtcgccgggggtgatgtcccatcgtgccacgtgtccgcatccgtccgcacggtgggatccgatgtggctgatcgagtggagcaggtcttccacctggtcggggtcggtggcttgcaggtcccattcgatggtgtcgatgatggatgccggtaccgtcaggtcacgggctttccatgcgtccaatccgtgatggttcttcctctctttggtgtagacggccagttgccagtccggtggcctgcgtctcaattggaggctggtccgcgcgaggatgtgcgggtgcgcgcgtgacgtcttccacccccaggtgccgcaggcttcccattgctccactggcagcaggtagtctttgatgcttcctcttggtggcgtcgggtcatgctcccgggcgtgcatggcccaggccaggagcccatcgagggggagcgggtttccttccacgccgcaggccgcgctgtcgagggtggcggcgacgtgcagtggcatgctcatgcgagagcctccaaaaggccgaggatgtctggtttgttatccgagattatgccgcgtaggtcacccgccgctcccgcatatggggtatccgctgtgatagtcgcgcgcccgtaccccgtgccggttttggcggctagcattgttttgccgtccggggcccacagatccagtgccgccttaagcattcgtacatccatgtctgtggcggctgcgctgagttcgaggctgccttcgagccgcgctccggggctgagcgtttgcacgctgtagatcatctgcgtgctgccggcggcttcagctcccatgtccatgagcgcggctattgggcttgtggcttggtccatcctggttccgaattcctcgctgcgccagtatccggcgggtttcaagtcgtcggtgtcgcggagacggccccggttttccgcgcaggcgaggatcgcgtcgctggccctgagcgtgccttcgatgatgtcgcttttactggcatacccgagcatggtcagccatgggaggatgcgtgcggcttgcctgtaggcctcaaggtcggtttgcgcgcctttctcagtgaccgcgccgcccgtgaagagcaggtccgtctgccctttggtgaggctcccgggttcgacttggagtgttttgacggtctcccaggccagggcgttgcggagcccgtggcggatggagtttgccgacaggaagggcacttgggcgatcctcccgtcaggggtgtgcaccgtctgggtgcgtaggatgctggtgttgccttgtgtgcctgcgccatggtggaagggcgaggtcagggtgagtccgtaattgatgatggtcatgtcagttctccttcttggtggtcttggcttggcggcggcgcatgtcagctagggcgatgatgtaaacgatggtgcggtcgatgtggtcctgccatgctgcgtagtccgcgtctatcagctcgcatgcggacaacaccgctgggctttgcgacacggtgatctgtggtatctgcaatttccggcatgcggtggtcagcatctggtgtgattccgacgatccggctgccgcggtctgtattgcggttgccgcgcgtccgccgctccaaaagtcgatgcggcttgggccgtcgtcggtaaggctgtcgcgcagggcgaagatgaggttgatggtcgcttcgtccatctggtcttcggttggggttgtctgctgttttgtcatgagtggtttccttccatgattggtttggttatggcccatagggccaggtctaggatcgggcttcctttccatgggttgatatcggagttaagccgtttccaggctttggcctgttccatgccctcgaagcgtggtggctggccggcctgcaccatttcggcgctggctcccatcctccgtaattcgagcgcgggccggtaggctgcggagaaggcttcctgcgtgtaaggcacgtccgccgtctccatgcggatcatgcctgtgggcccatggttgagccccgtgtatggcatgacgtgtttctgaccgctgacggcgatgctgaccgcccattcgctctcaggtgggttgaggagcagaccgaggattggtgacgtatcgtgccttgatgtcaggcagattccgtcatgctgtccaatccaagctgccgctttctcctggctgtctggcagtgtgacgccgggtgccgccgcgacgctccacatgcggatggtgcgcaccccccggcctgagcaggcccacaggcagcagtcgcacactcgtcctgattcggggctggcgtacagcgaccgatcggtgaaattcgatccaagcgctttgcttgcgtccgctgtgaccgcctgtcgcgtaccgcacaccttgcacaccgattccgactcggacagcagttttgccgccgccccttcgggttgcgggcttcccagcagcccccatatcatccttactgctttcatgacgacctcctcgccagcacaaggccggccccgaatcgtttgcccctgcctacccccgtcatcagcgtgttcgcgaactcgtcggggtcctttacggtggcgaacccgtggaacgcggcgcgggagatggtgagcggctgttcaccgtgccgtcccttcgcgggggacatttcctgcaccgcatcgatgtcagccttgcagcctttcaagtgccggcacagccaagctggcatatcatccgcgccgagtggcgcccttcgccggtgcgccttacaacgtgtcgcgttgatgacgccggatatctccacacgtgcgcgcgaatcgaaaaacaggcttgctttggcctgccgtatgcttgccgcctcacggcggaaggtctctgcatgcagtgggcggcgggtctgcaccagcaagaccgcaggccggggtgagcaccagagcgacgcggggtcaccggtggacgcggtgattatccgatgcactagcgctgaatcaaacgggattgctctgccatttcggttgaatatgatttccgtatgccacacgcagtttgtctcattcactgtttgcctcctccggtcctggctccatgccggtgccgtccggcgtgtgcatctttacaatccggtcgctcatgcgtcctccttgtagtcccggcagatcgcgatgtaccagccgcacacagtgattatgcggaatttgggggccctgaacagcgccttggccagattctcgcaatgcttggcgcgttcttcggcttcttccgcatagtgcatctccggccggcgggaggtgcggatcatccgatacttgtagatgcggctattgagccagtcgaaggccagccgggcggcctggacgaccaaccccaccacgacagcggcgaccaccaccacgccgcatgccaccaggcccaacacaaactcgttactcatgcgtcctcctctttggtcgcgtccatgagccactggcccaggcgtcgggccatgcgacgggtgatggtgatgtcgcgctcggcctcggccatgctcaggctcaccttgccagccgtcgcctcgatgctgaatggcgggtagtcccagccgccgtcggcgtcacccgggtagtcgatgacggcgcgcttggacccgtcgtcttccacccatccattgagcttccaaccgccgtccgtcatgggcagcgcggcatccggatgcaggtcgcttagacgcaagtgcgcgtgtgcgcgctcagccatcgctttactcattgctcaccccttgcgcggccgcgtatacgccatcgtttggcccttgccagccgaggaaccctcgtaacgctgtttccgcggcttgccggtaggcgtccttagcgaccggggcttcgcccgcccatgagtcgttgcagagcgcctgcccgctgtcacgcaggctctcatagattgtttgcgcggcctcgtcgatgttgtccacggtgagggcgcagtcggattccgcttgcttgtatcccaggtggaagccgactagcagcgtctcgtcctcgccgtccaggacgccggtttcctccgtgagataggccttgtaggcctgggcgctcttgttgatgtctagcatcactcctccttgccttgtccgatgatccggttgatgtccatgtcgccgactctgcggccgatgaagtgcccggttggcttgcgcctgggtttgggttgggcgggctcgatgcgtagccgtttggcctcctgggcggcgcgctcgtgcgcctggcctacgctcaacccgtgctgaacgcctttgatgagccgccgccggtaggcggtgtagtggtcggagtcgatgcccgcctggtccatgagccgaccgatctgcgcgtcctcagggatgcgggccttgcgcaccgctttgatgcccgcgttcacatcgcccgagcccatccaccggcccgtctgattgttggcgtagtagcgtctgaccgcttccatcgcgtcccgcatggtcgcatccgggatcagctcctcgtggaaagtcctggcttccaggtcggtgatggcggcgttgccgtggtgggcgcggatcttggcgagcacgagcgtgctgtccgctatgctcaggctcatgagccgatctcctttcgttggggtggtttgttttgtgcttgttcttcggccatgtagcgggccacgagggccgcgttcgcgtcctggttggcttgcgtacgagccctcccgaggctgctgctttgcgcgcgcagccggagttggtcgtatttggcgcggaatttgggcatggagaggatgttgcttttccagaagctgtcctgctggcaccagtcgatgaggcgggcggcttcttgggggtcccgtccgtccgtatcgatcatgaggcgggccgcgtccagccagcgttgggtgatgtcggggcgtttggacccgttgcgcacgatccagtcttgcaggcgttcgcagagggccacgatttccggtcttgattcgcggactatatttatatctttagatataaataggggtacgggtacggggttcgtttttgcttcatgttttgcttccgcatttgcttcatgttttgcttccgcatttgctgaagcgtttgcttcctgtttgcttctcctgaccttgccggacttgatgccaccaagcttcccagcctcggaacggagctctttctgggctttaactttctcccgtggagggttgtacttgaggaaatcgtggatctgccagtagtcgccgtggtcctcccacagtccgacgtcgacgagcgtctgcgcgtcctcttcggtcgcgtcggggtgcaaagtgcgaagcacccgcttaagcactcgcccatcagtttgcgaagcagaagcccaagcacctgcttcgacccagaggccaaccgcgctcaacgaagcctggaccatcttctcgttgcgcgtaagattgtcatcaaccttaaaccaagtcatctccgtcacctcctttcatacatgccgctcatcgtccgcgctcgatccacgggcgtaattgctcgaccctcgtaagggcctgccggagcatccagtcggtctccgggcacgggcaggagcgtgctgccccttcggcccgctcaagctcctgccgggccgcgtcccacaccgggccaagccgctcatgcgcgctcatgactcctcctcttgcgctcctgcgaggcgggcgagggtgtccaggtccatgagcacgtactggtcccccatctgcttgccgcccttgccgggacggtggaacacgaccatgccgtaatccgcgccggcgttgaacgcctccttcttggcctggtccagccaagtggcgagcttgaaccgtgtccagtccttgcactccagcaccaggctcttgccgccgatgtagaggcctttgatgtcaccctcatcggcgttgccgtgcagggcctcccggtggatcatgccctccgggtccccgatacggccgcgcacatagcccagcacctgggtctcgaacgccgtgcccttccgcttctgccggctcatgactcctcccatgcgggccagtcgcagcccatgcaatgacctgacgcgcttacagccccaccgcacagtgggcacgtatggtcaggctcgggaggcgtctccggcccatcccacgccgcctcgaacggcctcgaatcccatctcatggcctcgctccttccgttaattggcccatgcttacgccgaacaccggcgactcgacatgcggcccgtacctgtcttcctcgccaacccaatcccgcagatggaagtaatccagaaccgcgcgcgtgtacggcattacgttcaccgaggagaacgcgaggaaatcgttcttgtcgttctggaggaagaacacgcccttggtgacgccggtcagggtgtccccgtgtatcagcacggcgttcatgccgcgcaacgccatgttgaacaccaaaaaagggaacgcgcggtcggatatctcctgccccacgtacagccagtcctgcggcctgtacaggaacggatcggtttgcaggcagtgcgaccaccatctgctgatcagcagcccaccggtgcccgcggtcggatcgtacgagatgacgccacgatgcgggtcgttggaagccgaatccgtcaagtccgacaagaggtcgcacacctcgtccggcgtgaagtcctgcttgtgttttcgccggtccgcctgctcctcctcgaaatacgagtggaaccagtcatgcgtgacatccgtgtccacatccagcatttgccggaacacgcgctcacggtcgtctttgtccagtacgatctccatgacgcgccctggggccttgaacggctcgtcaatcccgaggacgcggttgatggcgtcggaatcgagcttagaattcgggctcaccgttgccacccccgaagtcctgcgcgccccacgggtcggacgtggcaggttgctgctgtgatcgcgtcgcgccctgcccgccgccccaggagccggcctggccctgctgctgccggggctcggagtggatgatgcccacatgcctggccgacacctccagcgcctgccgggcctgcccctgcttgtccgtgtactcgcgcaccttaagccccccgttgaccaggagcttggtgcccttatggatgtacttggcctggtccaaggcctgctttccgttcaaccgcacccggtaccaggcggtgccctgttccacccaattgtgcgactggtccatgtagccctggttcacggccacgctcaccgtggtcacgctcccgccttggaaggtccgggtctcgggatcgccgccagcgttcccggtcaattcaatcgccgtgctcatgttcagattcctctcttcaacgcgtccttcaattgttttggttgtgcccagtctcggcaggggtagcgtttgtcgatcgcgtgcgcgcaccggtcgtcgcctatgtcgggcctatggcagtgctcgcatctccgcaccgccccatgcaacagcccactgtcaggggtcacgccgccgcctcccccattccgagcgccttgcgcgtgcgcgacaccaccagctcaggcgcggacaggagggcctccgccgccgcttgcgacagcgtgccggtcgacccggtctcctcccccgtcaacgccgtcaacgcgcgcgccgcctgcgccctcgtggagacgccgccctccttgagcaggcgattgatctcggcgcgctgctccttggacgccatcagctcggcctccgccgccggctccccgtcccgcccctggtccgtgggctcctcgacgcgcgcttgcacgtccgcgtccccttggtccaggtcatccatctcatcaggcgtgtacgccacaccgtacaaggcttcggggcaggcctcgcgggccaccgcgctgatggcccgccaggtcagcatcgtcatgggctgcttacggtaattgtcgttaccagccaagcccatccgctcggcccacgccttatcacgggtcacgctgatcggatagtccgggtcatcggcgcgcaccaccgtggccgtcacgctcaccgccgcctcatccttagcgatgcgcagcttatggccagcgcgccgcacctgggcggcgatcagctccgcgcccatcgtcggcttgcccttgatcacgttgatccggtacaggctctcagccgggctcaagcccatcgactggccgaaaccgaccgcgaccaggatgttggccggcttgcccttatacgcggccgggatgatgtcgctgctctccgccagcttggcccactgcatctgatcgcgcagcgcgccgcccgcctcggtcagatcgcgtcccatgcgtcctcctcatcatcctcgtcctcgctgtcgccggcctccaagcccagcacctgccgcgcctgcccgaccagctcctgatcggcgtagatgtcatcccaggacttgaccttgctgaccgccaccgtgtccgccgtgcccctggacaattccacgccatcaggagtctcgcctccgaactggcgtatcagatgctcgatcgcgtcatgcttggtgaccacatccaccggcatgagcgtctcctccacgccgctagtctcgccatgctcgtccaaccactcggcgtacgctcgcgggtccttcacccgccacttgggctcagcgccccgcttggccgtcaccacgcccgtatgcgtcgtgtaatgctccctcgggtccatcacgtcagccatgtatcctttgagcgcgtccacccgctccgtgagcacccgctgcatcgccgtcgccagcgtgatctgctcagccgcctcatacggcgtcagatccccatccgctatctgatcctggatgctcttttgcatcacttatcctccttaacgtctccatcggcacttatcttgtccggcccgtcctcgaagtgcaccggctcgaacggggcatattgcgtgatttcgcacagatcgagcgggctcgggtcggcaatgggctcccctcgatgctggacgagcgccgcccgcccccactcactgacgacccacacgtcaccttcccggtcccggtagtagccagactccgtgggcggcttgcgcagggacacggatgccacgcaatcggcaagacgccatgctttgctcgtgtcgtcgcgctccaggatcgcccggtggtcgcagtccgggcccaaggtgattaatgtaggggaggtcagcatcaggtccgttaccccaaagccgttgcaaaatttaacgtgcacatgcttgccctccagctgttcagccgccaggccctcataccattcactcaattcgattcctttcaatgcttgttgcttatccagctgacccagacggccagtcccagcaggagggccgcgagcgcttgctgcatcactccgcccgctccacccgcgcccaagcccgccaagccgccggcaggcaggcgaggaggacggctgtgtgcaggattgagatgacgccgtgcgccaagccagccagcagccataggatcgcccacacgctcagcacggccgcgagggccgccgcgagcgcatgccaccagtcacgcgcggtcatgattgcttcttcccgtagttcagggattgggcgatctcttcaaggtcgccggggcgccaatagtaggaatttcctataaagattccgtggtcgcgcgctagtttcatgaatgtgtcttcgggcattcccgcgaacagttgccgtgcctggtttttatcgagtagtaatggtttcagttcactcatgccgtcacctccatgtttgcggtcatccatatgagcgccgcgtagatcagtaccgccacggccgcggtgcctggcgtgaccggctgctgctccctcccgattcggagcacggagttcaccatgcccatgaggaacaggcctattagcacccattgctgccaggtcacgccgccacctccactgcgttcgagcgggcggtgttgaggcgttcctcgcttatccgccgcgctatcagacctaatcccttcgcggtcacccgcagttgcgggtggaaggcgaagctcgtgccatcacggtgcgtgcccgtggtcttgtaggcgcgcatctccaaatgcccggcattgacgcgctcctggttagcgacccaatgcccatcccgcatgtaggcccatgcgtgcgagccgagccacgagtacaggtccttgacccgcaccacgccgccggcttcgctcaagagcttggcggcctcggccaccgagtacgagccctcggccgaggtcagcaggtccaaagcgtcggccttgggagccagctcggcgatacgcccctcctgctcctcgatcgtcttctgcgcgatcagcaccgcgcgggccatcgtctcctcaggcgactcagccttcggtatgtagccgccagtacgccggatctgcgggagcacctcatgcgtgacccaacgctggaaccgtttagcctctggcttatcgctacgcaagatgatcttgtacaggccagattcattgacgatccaggcctcgccctgacgacctagattgaatctagaccgttcatcctcgtccagacgcttagccaggtcagaagcattctgcacttccaaagccttggccacgtccgaaagcacccaccaagtgagcccggtctcgaacgtcagcgtcctaaccgagtgcccctcgaaaacgaaaggccgtggtgttactgttgtagatgacattggattcacctttctttgtcaccgccgcagtggcagctgcggcatttacttacttatgagaaaactgtgtataggatttgcgatgggccccttacccgaagcgactatgccgaagacatcaatcccgctttacatcatgagccgtcccggtccgagcacagctccacgatgatggccatcaacgtccaagcgaccatcatcgccccactgacccactccgggtgccacaccgtcaccagcaacgccaccagccacatgacctgatgttgcaaagcatccaacaaccgcatcaacgcaaaccccccattcctcagccctcgtttttcctgaccagttcccatatgtcgcgcacgtcatcggctaggtccttggtgttagaccgcaatagaccgttgctcagctcccgtacctcccgctggtccgaattcttcaaggccgaccacaagccagtgagctgcgtatccgcccgctcaagcgaacgcaaagtcctacgcacctggaatccgataagccgaacacccatacccatcacccctaagccgtcaaacgctgagaagaagcaactggcacatcaggcacttctctgaccgttgcaacttcacccggcgtaaaaccgaacgcgctgtacaatccgacaatcagcaccggggatgccaccccagtgcgtttagctttgctcagcgcgctttcgctgactcctaacgcaccagcaaatgcactctcggttttcagaccactcatgcgtttcgctctttcaagaaaaccgtccctgaaaaccatctggtagctcaaaaccccacctcctcgtattcataatgaagatttgtttttcgtgttgaatatcaatatatcatcatgaaaatgtaagtgtcaatacgaaaacacgcccgcgtgtcttgacatgaagagcagtttatttcataatgaaaagcatgaacaaagacgaatggctagccaaagcaatgggcgacgatagtgtcaacgagatggcaaccaaagctggtatttcctcggcgacggcatggaggcagtacaacaacgcacttggcttctccgctgaaaacgtcatcctcatcgctcgcgcgtaccacaagaaccccatatccgctcttgttgcgttcggatacctgcgacccgacgaacccgccagtgccggtacagaacaggccttgcgggacgccagcgatgacgaacttatggacgaaatggcacggcgcctcgccaacggtgcggccgcgaggaaccaacgatgggggtctcccatcactttcagccccgaagacctgggcatcgcggccaacatgaacccggacaaagactccgaagcgaacacaccagacgattaagcaagcccaagaggaaggggatcgatgcccaagatcgaggatctgtttgcgcaggctgaccagatgggactcagcgtccaggaagtctacctgcccacaggttgccaaggcatctataacgacaaaacgaagatgatttgcctagacccgcgcatgaatcagcggcagcagttgtgcactctgcagcatgaactcatccacgccgagcacggcgaccagggatgcggccagtcgactttgatgcgcaaggccgaatgcaggacgagaagggaaactgcccgccgtctggtaacaacacttgagtacaaaatcgcggaaacggaatatgaggggcagccctggagaatggcttgcgagcttggagtgaccgtgcaggtcctcaaggattatcaacggttccttgatgaatgcgcgatggccgcgcccctgcgaaaccgttggtgcgatgacctctacgcctgctaacggtcaacgacgacgcggcggcggaggaggcgggcccaccggggtcggcgcatcccgccgcggggccggccggcgctcgatgaacggctccaggaagatttcatcatgcttgggcggcaattccacccgcatatgatagacgccagtgttgttgtcctgccggatatgggcctgggtcaccccgccctcctcaggcacctggaaataatggcgcgaggtctgcaagggcgtcagataaccagccgactcgccatccaaccacacctcgatcgtcggccacccctcataccgcccgtcacggatgtgctcgcgcgtgaccaacacccacatccaagcgcccttgccataccgggcgaactgcccctgatgctccccgcgcttcgccacatccacgcccgcgcactcctcgacatcagcgatcaggcagccatccggccgcgcgttgcacggctcgcacccgaacgcggcacggtagctgcgccggaaccgcgcctcctgctcctcgacgctctcctcatggtcaggccgcggctccacccggtaccccaaccggcccggacgcccgccagggccagcctcaccgtcaggcgtccgccccgacgcgtcatgcctgcccttggagcccttgcccttcatcctgacggcacgcaccaggctgtaagcgcccaaccccagcagcccgacgataatgcccgcgaccggactcgctatcaccaggcacgcgagtaagagccctacgacaatgtatccaaccttcttcacaaccgcatcataccaaggcccagccaaacgaaccgtccacccctaccggcgcgactggagcgaggacccgatcgtaggggcatgacgctatacaccctgactgataggctgctgttgtcacgggcgacagtggaggtaaagggatgcgaaagaaatacagagcggcgctggtgtgtgcggtcatcgtcgcctgcctatcaggatgtggagagacccacaggcaggcgacggccacagggacgacggaagcaccaaccccaagccaggagaccacgactgaaccgacactccccaatggactgtccgggtcatgcacgggagatccggcaaacccaaatcatctgcaccaggtgaacctgtccacctccgaggggcagctcaacatctcgataccgaacgccgatgacatgatcctcgtggacgttggctactacatcaacatccatgccggggcgtcagcgtggacgcaggtaaggatcgagcactcggagcaaacgggcaccaacaaggtcaccgtacagaagatgttctccaacgagtccgtaaaaaacatcggcaccttcgacgttgacaagggcaacaacaacgccctcaacgtctcggtcccatcctcggaaatcactggggaccaggacctgacctggaacgccgcgcttgacatgaacggaaaggacctggcattctgcccggcccaccaagaggataaagtcccactgcaatgattcttctcggccccgcttcggcggggcctttccgtatccgtccagtcatttaaaccaacgacacacacggccgcaagccccggcattccggggcttgcgcatttaacgccgtcttgcctgggcgcgacgtcaagggtctgtttcgtccctgcgcctacatgcttcggcggggctttcgcataagagggaagagggatccgcgattccagcctgtcaccaatcgatgggggctcgaagatcacgaaccagtttcttgctgtttcctggcaacgaatgaaacccatgatctcgataccaaggcaccagatcctcgttcaacgcctggacatacatggcgcgacagcccacgttctccgccagagaccttgctttcattatcgcctctttcagcagcaggggaccttgtctatcgcatccaagcgactttcgtcccccatgccggaacttctggttaacaccaagccttccaagcagaacgcacggaatgttcccggtaatgcccatcccgggtttcacatcctccggcaaggctctgaactgcagataatacatgttcaaagagaaaaaaccgattatcgtaccatccgtacccaaggcgacataaacggtgcagcttccatgctcctgctgttcccaagcgtccttctggagccagatatcgatttcggattcgccgcaaaggaacttgtccagttctatggtttcatcgagtttgacaaccctgtcccacagtacgccgctccccatgcaaccccctcgtgcgtcactctgccagaaaggatttcagccagtcggcgtcttcctgggtgatgaatgtccggtcagacacatcagccaggttcggtatcggtgccgcatggctcttggaaggatccgcctgcaatgcggaataataatccagcatgctctcccgcgttatgactttttcgccggatttcctcgcatcagaccacggatcctcggcatggctcatttcctcaagcctgtctccaaggtccccgtcctcaacatccctgtacgattccatgacacgatcgaccagagaccgctcctccaaggccagcccgtcggcatctccgtcgggaatctcacgcgggaagaggtacttatgacccttacaatacgtaaagacctccggcactacagggccatgctcccacgcctcgatcggttcatcaaacagttcccggtcctttgccacaagcatccatgactggcagtaataaagcagcttctgcagtgcgaatgtcgtggtcatgtgaccctgtgcatccctttgttcaaggatataacgggcgacgtcctttgctttcgccatgcttttcaccaccttctcgtgccccaaagtcgtgggacgtggaactcccccacaccactatgccaatcggccaattttactcgcaagcaaattatagcagcgacgcattacataatccaagccagccgattactcgatgccgagcgcgttgtcaagtttgagcatggcctgtttgcgttcgtccaggccggcggtccggtagccatggtcatggcctcgctggagtggactctccagcgctggtcttgggtttcctgccgcctacgcctttacgtgacttgacccattcgtcgtgccgctggcgttcctcggcgtcaatctcctcctgggtgcgttccctgccagcgggcagaagggtttgaggcaggttgagggcctggggtatggcttggacggcgtcggcgcgctgctcggcgtccacagtggtgtagatgtcgtccactttgacgctggtgtggccgatcatctcctcgatggccttggtgtccttgccggcccggcgcatgagggtgacggcgctgtaacgggtctcgtgcccggtgcgctcccgggggtccatgccagccgccgcgaccagcgctttgaactcccgggtgtccttggcccatatgcgcggcgacccgtcgcgctcgcggaagatgagaccgtaagggttgggccagtcctcggtggcctgtaaatagaagcacatgacctgggcgagctcgggcacgattggcaccggcctggccttgcccgacttgggggcgaccaagcacaggcgtccggtcagatgctccatgaggtacccgtcggggacgcgccacttggcgtccgggcacagcccccccgtggagcggccgcatggccagcggccgtcgaccttgggaccgcacccgtggtcgcggggtatttgcgccaacgagcgccttagatcgtaccaggggcgctgcccgtccaggtggaggtatttgagctgggcgccgaggatctcggactggcgcatgcccgtgaacaggcgccaccaccagatggcggcctggcttggcggcatgtcgagggtggccatgagcagggacttgagctcgggcacgctgaacgcccgccgacccgtgtccacctcggacaggccgcgcactttgacgcctttgaccgggttgatctggatgaccctatcgcccagggccaggtcgaatatctggtccaggcacgtccataattggtgccggtagctgacggagcggccgtcctccttggcgcggtcgaggatgcgctggatggtggtggggacgaagtccgcgatgcgcagactcatccagtccttgcagtacttctccacgcaggtgcggtaggcgccccaggtggacggggcgacgcgctgctgggcggaggagaggaagaggtcggcgtatttgcgcaggctggcgctcttgtcgctgatggcgccggtgtcgcgtatctccttgcgtgcggcggcgagcttggccttgacttcggcgctggtcttgccggtgaaggtctttcggatgcgcttgccgtcggcgtcgtagccgaggtcgagccggaccttccagcgttgcacccgcttgcgttcgatcgtgccgtcgctctttttaacggtgtatgagctccagtaggtgtacggcttggcggccccggtcccacggctcttcggcatctagattcctcccccaaaaatgtttgtgccccatttgtgccccatcctactacaggctagtaggggtatagtaaggatgtagtaaggctgtaatcgttgcaattccgccattcttgtttgtcggcgccgccttaaatataatccaatcgccagacttctaatctgtaggtcgcgagttcgagtctcgccggggtcacgaaggggtagcgaccaggttgggcgatcgtcacttccacgaagccgccttgggccggttggagggccaaggccttgctagcgggcgaaccggtggcgggggcggccaactgggcgtcagtccggcctggctgggtgatcaggtagcggccctcggaccagaccgtgtcgaactgggctccaatcaggtggaaggacaggggcaggttggggcccgcgttcaagagccacaagcggaccctgccgccggccggcgctgtgagcgggtgggcatcgtactggtatggcctaccgttgaaagccatcaagtcggggcgcatggcggcaagcttgcccggatccgcgccgtccccatcgcctcccaggtagagctcggattgggtcagcacgtattcggcgtccaccgccggcagggtcccatcatccacgaccacagcgccgaacatgccattggctatgtgcaaggccatgggctcggagctgcagtggtacatccagatgcccgcatggtcggccttgaacgtgtattccaggctttggccgggctcaatcggccgcatcatccgctccgggagcgctggcccggcatggaagtcaatcgagtggctcatactcccctcgttgcggatagtcatgtggaaagtatcgcccacccgcccgcgcagaaccggccccgggctcatcgggcgcgtgtcgcccttaccaccacgcgggtcatcgccatcatcgtaggaccacaccatgcgggtcagtcccggcgccagcggttcccggcactcccggatgacgagtgtgcaggaccgcaggccgtcaggcgctggtttcagggcaggcagaccggcgtcgaaaggctggaccgaaccagcgaacttcttcgcttgggcggcaatagggaccgcagcattcccgaccggctcccagctttgcccggcggtccgcgccgcgccaccggcagccgtgatggtcaggaccatgcccatctgccggtggccaggcagggagcaccagcctccggtgctggctgtgatgacgcctaaatccacgcgggcgtggcctccgtgcggcaggacgccggtcccctgcccgctggcgaagaccaggtcgtggcgctggtcgccggtgttgctgaagtccacaaccaaccggtcaccggcattcacccggatggtggaagggctgaaggacatgcccgagacccgcacatcgaccctccgggttcgtccggtaggaaccaccatcgcaccggaccccgtcgcggcagccttctgtccggctcccgcattggcctcgctctgggcgccgcccaggggagaggccaacccgcccggtagtcccaccgcaatcagtgagaaagccaaaaggatcaaggccgtcaccgccgtggaaacacccatcacagccttcctatggcggtccggcaaccaccccgaccaggccagcggccgctcggaaggcgagctcgaagcggaagcgccatgcatcctcaggtagcgcttgcgctccagcaccccctcgctcctgaccgtaagcaggaaaacggaggccatcagggacaggagtccaaggatgctgacgaggtcaccggactgccagagcccggtcagcgattggatcgtgcccaagagccgcaagaccaagccagcctgcacgagagccaagtccagcttcaacaccgggtgaaagggcatgggccggcgggtgatcgacggcactatcatgcagacgtgggcgatgaccatcgtcatgacgaaaccaatggccagggcgtgcagggccatgtccttccaatatccgccaccgccggcgggccccaccatccaaatcagcgccgccatcaatccccaggcgtaggcgatcaacatgcacaggcccataaagcccggtagcccacgacgccgccaagtggagcgagccacgtcatgcctgaccataacagccaatagcagacccagcgccagccccagaagggggtacccccaagacgggcggaaatctgcccaggcaacaggagtgcggtcagcatgctcagcgccagcacgccggcctccagcctcggctcggaaaagacggcccgggccagctccacccgctcccccacaatcgacagcaccgggaacgacagccaagttggggacaggatgaaagcctccacaccgccagtccacatcagcgccccagccaaacccaccagtgctgccaggaactgaaccagcaccgcaatggaaggctgccgccgccagatagccaggtatatcaggcagaggaggaaggtggaagcgcaccagcagagcccggcgccgggtcgggcccaagcgcccagcctcccgcaaccgggcagcgcggcagtagcagtgaaggccaggaccacgagcagaccgagagccccgaacgcgggagccaggaagcaccatctgaccgttcgcctgccgccacccctgtaagccgcggcccgctcaaggctgatcgccgagcccaagaagccgtaaatcatcaaagccccgtggaagtccgccaaaatcaagggcgaccctacctccaagaggccggagcggaccgacgcggctaacaagccaagcatggccgagagccccgcacccagcaggagcgccacccgcgctttggggaaggccaccgccctcccagtcggcctggtccgcccttccgtttccatagccgctgctcccatccgtcggacctctgcgcccggcttgcacaacattggtcaacggccactaatctaagagccccgcctgcgactcgccagaaccgcaatgggcaggcccggcttgacacatccgaggtgacggtaacgagcagcgaatgtcatcgtgcccgcctgcatcctgactggaacttccacccatccaccccccgccttatccttggtggactgtccgagccgcttgcgggcggcggtccacgattgtggggtgacgagtatgacgtatgtgattgcgcagccgtgtgtggatgtgaaggataaggcttgcgtggatgagtgcccggtggattgcatctacgagggtccgcgtgacctgtacatcaatcctgacgagtgcgtggattgcggggcgtgcgagccggtgtgcccggtggaggcgatcttctacgaggacgacctgcccgaggattgggcctggtacaaggacgcggccgtcgacttcttcggccaggtcggcaacgcgggcggcgcccaggcccacggcccctacgaccacgaccacccccaagtcgcagccctgccaccgcaggatgcgttcgtctgcgtgcaggagcaaaccaagacccagcgcgccgtatgggttccccggaacgaggtggagggggcatgacaggaggcgcggacccggcgggggcgagcgcgcgaggcttggacgccttccatcgagcccaagagctggaggaccaggtggtgcaaggctctttccctgatttcctggacgggccggtggatcaggcggcccgccgcctcctaggctgctttctcctgcgcgattatgaggacgggggccgttcgattgtgcgcatcgtggagaccgaggcctacgaccagaacgacccggccagccacgcctatcacggccgcagcgaacgcaacgcggccctattcggcccttcgggccatctctacgtctatttcacctatgggatgcattactgctgcaacatcacctgcgatcaagacggcttcggcgccggagcgctgattcgcgcctgccagcccgtcgccggactcagcctgctaaaatcccaccgccacggccgccatcccgaccgcgacctgaccaatggtccagccaagctctcccaagccatcgcggtggataagaccttgtacgcacacgacttgcgccagcctcctcttcgcctggtccagggcggcttgcagaccggggagcgggtggaagccacggtccgcatcggcatctccaaggccaaggacgcccgtcgccgctatatcatcgccggcaacccctacgtctcctgagcggatcagccaagcggaagggagcgggacgctattcgatcaggcaagccatagccagcaggatggcgaggaagaggacgttaagcaaggtataaattttcaggtaccggccctttgactgcgggtatttcttgcccacggccttataggaaatcaaggaagccatcgaggcgatcaacgtgcccaagccacccaggttggtgccgacgatgatctgccgccaggacgaagagaagccagagaccagcagggccgtgggcacgttgctgatcacctggctgcaggccacggaagtgaccagcggatatgcgccgaccagtccggagacaaggttgtagaaggcggggatgcggcgggcgttgccgatgaagatgaagaaggccgtgaaggtgagcaggagcccccaatccacttgcaggaagacccgacggtcgcataggaggaagccgaaggccacgatcgccaccatggcccactgggggacaatcccgcccacgccaagcaagcagaccaggaacagggcgctgtacaccgccaagcgccagccctggatgggagccacttggacctgggggtggatgccgtcggattcgggcgccagaaccgagcgctggatgttggaagcccccatccgctccagcgatgagacacgtttggggcggaactccaggcaaaccgccagggtgagcaggacggccgaagcaagcgtgtagggggccatcagcgccaggaaggacgaggttgggatgccggaccgggctttgaggtagagattgtgagcgttgccgataggggtgagcatggaaccgaggttggcacccagtgtcattagcgaggccagcagaaagatgcgatcctccaaacctgccatgaccaggaccgcgatggcgaacgggatgaaggtgaccagggccacgtcgttcgtaatcaacatgctggtcaggaaaggcagggcgacaagcaccagcgccaggccgcgtaccgtgcgcacgcgcgccagcaggttggagccaatcaggtggaaaaggcctatccgctggaatccggcgaccaccgccattagggaacccagctgggccaaggtgttccaatggacgtagctagcgtacaggtggtcagggtgcacgaaacagcaggagatgatggcgatgacagcggctacgacgaatacggtttcgttcttgagcagccctagggcccactgtcgcatcgccgcctccgactcggtgtccattccgcaatcaagtgtacgctgaccgcccctgcgccccgccaaagaagcggattttcggaacgcgccgggcagtggctcatcccctgcgcaatgaacgggccctcccgaatggttgcttcaaccagtcgggagggcccgaaaatcaatggcgccgaagcaccgtcgtcatatcagtcgtccgcatgcttggggatgagcaaagaggccgcataggcgagcgccagcagcgccacagcgccaatcatgctggccacatagcccgtggtgccattgccagacgaagtgaaggcgttcatgaaggcgtacagcaccgcgtacgacaggcccgcacccaggttgaaaccgccggaattgagcccgggcaggtacccggtgttgtcggcgggagagagcacgacgcccaaaccattgagcatgatgttgaccgtcccggcataggagacacccagcaccagggagaggaccacgagagcccacacgctcggagccttgcacacgtaaatgccgaagagcaagcccagtacagtgaccagcaagcccatgcgcaataccttgtgataaccgaacttggaggccagcacaccggcgaccgggccgaaagccaggccgatcagcgcgtacggggtcagggtggcgaaggagacgacgctggctgagataccggcgccgaacttggcgtcctgagccaaggcggggacgatgccgttcatgatcgcgaagacgccggtcatggtcagcagggtcgtgagcagcagaccccaggtgcggcgctgcttgaggtagtgagtggtgaccatgggggccttggcgcgcttctcgatctgccagaacacgacgaagaagatcgcggcgacgacgatctcgccggccaccatcatccagttggcttcagccagcttctcaatctcgttgatggccaggtaggtcatcaggaaggcgacgcatagggagaccacgccaggccagtccatgcgcggtgtctccgccgcgtggctttcgctggcgaagatgaataccagcacaatagcgatgacggcgatgacgaccatgaaccagaagacggaccggaagccgaaagtgccagccagccagccgcccagaatggcgtccacgccgccgataccgccgttgacagcggtcagaatcgacatgagcttggcgtaacgggtgtcgtcagtgacctcgtggtgcagcatgatcagggtcatcggcacgatagggccagcaacgccttggaccacgcggccgaccatcagcatcggcacgttgactgccagagccgagatcacgcagccgatggcggtgagcaccagcatgcccaacagcactttcttacgcccagccaaatcgcccaaccggggcaggaagagggagaacacggcgcaagcggtgaagaacacggtctgcgtcagaccaatctgggagctggtggtattcagctcgttctgcatggtcgtcagcgctggggagagcatggacgcattgagctggaaggcgaagacggcggccatcagcgccgtcatcagggcggctacggacttgcccttcggatctttcatggttcctgttacggtttgcgacatcacactcacccaatcctcgtaatggcatcggtcactaaatcccagaatttatcgaagtccaacttcgtggcgacctgggtgtggcattcctccggggaaggttcaggaccgcgcaaatctgccacggtcatgcccagggtcagatccccttgggtctccacatcgaccgggcagcgtcgggtctggaccacgctggggtcgatcaggtaggccaccgtgcatggatcatgcaccggcgggtcctggaagtcctggttgttctggtacgccttgcggaagaagttcatcagtccacccacgaaatgcgccaagtcagtgcccaggccctcgatgcgctgctgcacctcgggcgtgcacaaggcttggtgggtcaggtcgagaccgaccatggtgacgggccagggctcgttgaagacgatgtgcgccgcttccggatccaccttgatgttaaactcagcgaccgcgctccaattgccgacgtggtacccgccacccatgagcacgacttccttgacccggtcgacgatgcgcggttccatccgcaccgccatggcgatgttggtcagcggcccggtgggcactagcgtgatggacttgggctcggcggccatgatggtgtcaatcagccagttaacggcatgcccctggtccagcgggcggctgggcttaggtagttccacgccatccaaaccggtttcgccatggacggaggcggccacctccaacggcctgaccaacgggcggtcgcagccagcatgcaccgggatgtcggtggcatgggccttctccaacaccgcccgggcgttataggtcaccttttccagactctgattgcctccgacagtcgttacacccaacaggtcaatgttgggattaccgacggccaagaggatggcgacagcatcgtcatgccctgggtccgaatccagtattatcttccttgccattacagtcactttctttcttcgtgttccgaacactcatctaccgccaaaagtgcgcagcaaactgtccgcggcttccaaatctaccgtccgaggcgtattacccgcaaacttttcttgggccaccgcttgcgcgttcgtcagtaattcttctcgactcagcccatatgactcaaacaggcgcatccccagcatacggtcccggaagtccttaaaggatcggcaggcgatgaccgtcgtctgctcctccggtgcgccctgggggtatgcagcgcctagaatctgaccaatttcccgcactttgttcgctctgactggacccacgaactccattacggagggcagggcgtaggccaccgcatcgccgtgcacgatgtggtactgggaacccaacacgtgagcgattgaatgaccgacgatggtgccggtgttgttcaacatccagccggccagattcgccgccaccatgacccgctcccgcgcctctctgtcagagccgtcccgtacggcccgaggaaggtaattgtaaaggaggaacatgaccttctcgcatacggcatcggtgactgggctggagagccgggacagatagccctcagccgcgtgaccgaacgcatccaaaccgcaggcgatcgtcatatccgcaggaagggtcagcgttaggtcagggtccagaatcgcgtactcgctgaccgcaggatcagccaagaccgtcatcttgcgactgctggcctcatccgtcacgaccagcgcgttcgacatctcgctgccggtacccgccgtagttggtatggagatcatacccgcgcacggcttgatgggtttggctgggtccgtgtactccaaaatggctccaccgttgacccggatgatgttgatttcgttcctctatcggctctgagaaacatccttcagtgcctatattcataattcaaactttcgctgatgaaccacatatcggccttacgacgctgttcctcatctatacgctgagtatccatcacaaatctctacccacttccagcacgacccgtcaacaccgaaaaccactgacttccttaaataatggctgggacgttttcgctaagcacctcgaagtaatcttgccctacaccgtattccaatcactattgacgtaaagacccgcgatgcaagacacccgatatcgacaaacttcactagctgacagagagcgagattatgggcgatggctcgctacacccacccttcggattcggccccttcctcatcccacaggctaaagcagccagcgtaccgagagtagggccttccatccgcgaagtgcggctaaatgcggagcaaacaacatgcaagaaaattggcagatactatgggcctacgcctttacctgcacgatttgtttggacacgctttagacgctaacaccggcatccagaaaaagagaaacagcggcaagcaccaggtcaagcgcaccaactgcaacagcagtctgtatatgcgcttcatcatcttcgaacaaaacccgagggtaaacaaagccaacaggctcatggtctatgcctatttagtgtctgcagcgcccttgatcgtcagcaaacagcgatctttccccgtcatatcggagtcagttctgacttgagtaaagccagcagcgctggcaactccccgcagaaccgctgattgcgaaggatcgtgttccatgaccagacagccggctggacgaagcaagtcagcggctcgagcgatgatacgcccagggatggccgtaccatccggggaggcgccgtagagagcctggggtgggtcgtaacgggtgacttcgggctgggcggggatttctcgctcgggaatgtacggtgggttggaaatgactaggtctacgcggccatttaaatccgccagggtttcggcggcggtggcgtcggcgaggactagctggtagctggaaccattattagcgatggcttgccggtaacggtcagcgttgcggcgggcccaggcggcggcttcctcggatacctccaccgcccacacttgggctccgggcacctcggtggccacggccaggccgatcgcaccagatccagcgcacaagtcaaccaccagcgggcgctcgataccctcccccgccagccagtccagcccggcctgcaccacggtctcggtctctggcctcgggatgaacacccccggtccgaccgctaaatccagaaagcggaacggggcgtgccccactatgtattgcaagggctcgcgccctgcccggcggatcacgaaatcgcggaagacacccaaagccagcttcccggcctggtccgggtcaatgtgcactatgaccgtggccgcatcggcatcagcagcgtcaccaacaccctgggcacgagcagcgctccccctgaccccggcagcagccaaatcgcttacggtctcccccaggagcagggccttgtccagatcgtgcaaatcaactcggcatgcctccgccaacagcagccgggcgtcgttctccggcgtgtccacaccagccccggccagtttgccactcgcttcagcaaggatcgcttgcacaccggctcgctcatcggcactcagcatgtcgctcccgctaatcgccatagcggccccctcactcgcccggagcagcggcccgtccaagcctcacttgcgcccagccagacgcgcggcctcatcagcttggatgtcggagtcgattacggcctggatgtcaccgtcgagcacctgctccaggttgtaagccttgtatcccgtgcggtggtccacgatgcggctttcagggaagttgtaagtgcggatgcgctcggaacggtccagggaacgcacctgtgaatggcgcatgtccgcagcctcagcagcctcctgttcatgcttcatggccagcaggcgcgacttcaggaccctcagggcggcggcgcgattttggatttgcgacttctcgtcctgcatgctcaccacaatccccgtcgggatatgcgtcatgcgcaccgccgaataggtggtgttgaccgactggccaccggggccggagctcatgaaaatgtctattttcaaatccttgggatcgatttcaatctcatcgtcgtcatcgtccgcctccgggaagacgatcacacccgccgccgaggtctggatgcgcccctgcgattcggtcaccggtatgcgctgcacccggtggactccaccctcgtacttgagcgaagcccagacgccatcggccggcgccacggacccacgcgaacgaatggccagctgcgcgtccttgaccccgcccagttcggtggcgttctgactcatgatttccacggaccagccacgcttctccgcatagcggatgtacatgcgcatcaggtcacccgcgaacagcgccgcttcctctccgccagtgccggctttgatttccatgatcgtgtcccgcgcgtcatccgggtcgcgaggaatcagcgccgaacgtaggcggtcctcagccgccggcaaccgctcgcccaagctcttggcctccgccatgaaatcagggtcatcatcggccatgctccgtgcggcctcgtaatcatcgttaagcgtgcggtatgccttataggcctccacgatgctccccagctcagcgtgccgacggcccagcttacggatctgcgcggggtcagaggctacctcaggctggctcatctcccgctccaggcgctcgtactcctcaagagccgtccgcgctgcggggaattgctcatcctccatgatctccaacctttcctcttacgcatttccgcttcactaggctctgggtgcgccatccgtttggacatagaaaaacgccagcctcagcgaccgggcatgtcaagcatgacccggggctcaggctggcgtgaaaacgctacttgttcttgttcctcttgccgtagcgagcctcgaagcgggcaacgcgcccaccggtgtcgaggatcttctgcttaccggtgtagaagggatggcagttggagcacacatcaaccgtcatgtgatcgccgggggcggtcgagcgggtgacgaacgtattgccgcacgagcacgtcacctggacgggatggtaatcgggatgaataccctgcttcatggtttctcctagggtccgaagggatccgggtcgcctgcccctatggccgacgtgaaccggaaccaatggcgagtatagcgcaggcccgggagattgccccagcgaggaccgcctgccgccgcggttttcaagaacgtctagaaagacatcctccgccatgctcacatccctcaaccgcatggaccccaggcctattcccgactgtttcacaacacaccgcccatggatgacgattcggaacgaaccgagattccaacgctctggaggattcaaccactgcccgggagacagggcgcgttgacatttttcgaaccgttacgctaatattcatggacaggtagaaatctctcgtgcattgggggatgcatgaaaacggttagccgcaaggggtgaagtgcaatccacttccttccttgctctctgaataaagatgtatgccgcaaatagagatggcgaccgctgttggagcttacctgcaattcacgcagcaaggtcgtggttatctttattcgtgagagatgactgttgccataactaaatgaaggggattcgcagagaatcacgacccggactggtatatccaggcaatatagcggggcgtccggatgagaactcaatgtttgggaccatcatcttgccccgcaactcgacagagtcgggttcccggtccgaagggacgacagacgcgatctgattctattcccccggctgaagcaggcggttcgccgtttgtggatgcgagagtcagactgcggtaaaggcgggttccggcgtcaaagccggggcccgctttttcatttttcctcgaccaggtccgaaagcagcacgggttccacgaatcaaccaaccgtaagggcacccagagcacacacagaggcgtcgacaagccagcaaagaacctctgcaacgcgaggggagggcggcaggggggggggaaccatactcccccaacgccctccctttccggtgagacacgttgaactcgcccccttgttaggaaaccactacccaagttggtcagctgcggttataatgccttcgatggccctgacctgctcggctctgatttgcgtcgccggctctttgatggccgtggaaacaggcagacctttgatcttgaccgctgccttgatcgcgctgatgaaaaggtcggcttgatcgtatacggccataagcgcgttaatccgccgggcgcaggcgagcgcggtcgtgtaatcaccaccctgccaagcggcgtgcatccgcacgaaggtctcaggctcaacattggtcaagccgcacaggacgccattgcccccagcgatccggttaggcgtgtaatactcgtcgaagccggataggacgctgaacgaaggcgagaccttgcggacggcggcaatcaccttacgggtgtggctgatcgtatcgaccgtatctttgagccccagaatattgctgtggtctgccgccaactgggcgatcaattccgggctcagatccatgccagtcctgggagggaagttgtacaggaggaccggcaggctggtggcctgcgcgatctgagcgaagtaaacgctcgccgtctgctcgctcgggccaaaataataagggctgaccgccacgaccgcatcggcaccaactgtttcagcgtaatgggtgaaagccaggacctcatccatatcggtaccgccgacacccgagaagaccttcattctgccagccacgcgattcaccgcgaatgcgagcgcctcctgtttgctctccagcgaatacgcatagaactcgccgatgctgccgaacaggagcaccccgttcatgccggcatcggccaggtggtccaggtgccggccccatagctcgtagtcgatgcttccgtcatcccccgtcaccgtaatagacgggcagaacaccccttcaaacgccgctgtcaccatcttgcgctcctcacttgaaccgcggttatcaccattatcacatcatgtgcgcgatgcttcgcttgcatgcgcgaacccaacgcccactctcctgctcgcgcgcagtggttgggcgttgaaccgaagccgtccctacatgagcggcacgctgagaatcagaacaaaaatcatcgccacaaccgaaagaacgcaagtcataagcgtccatgtcttgaacatctccggcagcgtgaaaccaaagtattccttgaccaaccacagtcccgcgtcattcacgaacgagaagatgaaggagcctgcacctatggcaaggaccaagagggctatgccaaccgggttaaggccaagcgaaacagcaaccggttcgaggatacccgcggtcgttattgccgaaaccgtcgaagagcctgtggcgacgcggacgaaggcggcgatggcccaggcgacaagcagaatcgatatgtgcgagctctgcacgaactgagtaatcatatcgccgatgccggtgtcaatcagcaaagtcttgaaaccaccacccgcgcccagaatgaagacgatgccagcgataggcttcaacgacttggcggtttcgtcttggatgcgcttccaggggaatttagtgaccttgaacagaactacggtcgagaaaatcagggagaagagcagggcgatctcaggatttccgaggaactgaatcagctgcggcacgaaagccttggaggtgctgagcttgggagcaatcatcgtggcaatcgaagtgatcagcagaagcacggcaggcatgattacgcaggtcaaagaaaggccgaaactggggcgcttggtgccctccggcggctgctcgattgcggacatatcgaaagtgtcgggggcgccgcgatccacgattttagtggcgtacctagcgaacagcgggccacagattattacggttgggatcgcaatcaatacaccaattcccatcgtgatacccatgctaccgtttgagaaggtcttcagagcagcggtagggccaggatggggcggcactagggcctgcatcgcacacaagccggccaaagcgggcatggcgatcatcataatcggcagcttggaacgccgacacaccatgataataaccgggaccataatgataaggcctacgtcgaagaagagcggcagacctaccagggagccgataagtgccatggtccaaggcagcatcttgaccgatgagtggtccacaagggtatcgaccagcacgcctgtggcgccggtgaccatcaacacttgcccaagcatggcgcccagcccgacgagaatgccaacgctctgcgttgttgaaccaaagccgtcgaggaaggcggtgatggtgttcatcatgccgtaacccgagcaaataccagtaaaaatggaggcgatcatgatcgcgacgaatgggtgaaccttggccgctgtcaccaaggcgatcagcaaggcgacgcccaatacgatactgatcaacagggcagcggggctaaggtgaactttcggcacttcggaggccgcctgtacgagcggcgatgacagcgccacaatgagcgaatgcatatgaagtccttcacactatcaaagcgaatgatggtactgtgcaccggcggcccatcgccaagcgccgttacagcgcattgaagggcgaagggccgccggagagcgacgatgcgcagctttgcgattagccgcggtagaggtacttttgagcggtctctacagtcatctcggtgccattgccgggagccgtaggagccacatagttaccctcgctaatttggatggggtggacgaaatattcgtgctggttgtccacgtattcgatcatccgtccgtccatggtgcccgagaccgccacgtagtcgaacatggcgaagtggcagaccgcttcgcacaggcccacgccaccggcgtgtgggcagacgatcttgttgaacttcttagccatcagatactccaggacaacctcctgggggccagccacgcgcgtggcgtcgatctgcatgacgccgaaagcgttggcctgcaagtattgtttgaacatgattcggttctgcatctgctcgccagtggccacgggaatcgggttaatggccctggcgatggtggcatgtccgatcacatcgtcggggctggtgggctcctccacccaagccaggtcgaaatcatggaacttgttgatccattcgatggcctcgggcacatcccagacctggttggcatccacagccaggcgcacgtccgggccgatcgcctctcgggccaaggccaggcggcgcaggtcatcgtccacattccgtccgaccttaagcttgatttgtttgaagcctttctgctcagtctcctcttttgcaatctggaccatcttctcatcggcgtaacctagccaacccgctgccgtggagtaacccgggtagccgaacttaagcaggtactcaatgcgctcgtccttaccccttttaccttcttgcaggatctcgatggcctcctccgggcgcaaggcatcggtcagataacggaagtccaaggtggcaactagttcttcggggtccatctgagccaggagcatccataggggcttaccggcccgctttgccttgatatcccacagggccgagaggacagcgccgatagccatgtgctccacacccttctcaggacccagccaccgcaattgcgaatcaccgacgaacagatcccatgctaggcgcatattgtccaacagctcctccacgttgcgtccgaggaggacgtgcgacatggagtcaatagcccggcagaccacatcgttgccgcgaccaatcgtgaagacgaaaccggtgcccttgatgccatcatcggcgtcggtctcaacctccacataagcggtcgaatagtcagggtcggggttcatagcgtcagaacctgagagagtctgcgaggtcggaaaacggaagtcatacgttttgacatttgtgatagtgctcataaaaggctccttcgtctttgataagtggttacaacggagtaatcccaataggaactctaagcgaaggtttagaaatttgcaaatcagatttggaagttttcttaatcgcaggtatcttcacatgtatacacttaatgacgcgaaccatgccgtctcataaaaccgaaggagcaggggatgaagatcagtgaactggcggaattggccggggtctccccatccaccgtctccaaagtcatcaacgggcgctctggaattgccgccgagaccagaaggcgcgtggagcaggttctcaacgagaacagctactacaagccgctcgtttcaacgaaactttcgcgaaccatcgaactagtcctggagcatgttgacgctgactgtaccctccccttgattgaccacgcctcatactgggcccaacaagcaggatatgcgttgaccatcacccaaattcactcaggagaggaggtcgaacattctttccgtggcattatcgaccgtaaccctttaggtgtggtcatccaccaaatcactcaaatcccccaggcggagaaagaccttctggagtcacggggcatcccgttcgtaatcctggaccccatcaccccgattgacgaccaagccatgtgggtctcggttgaccgctggacgggcggtttccagatggcgcaatacctcatcagtctgggacacaggcgcatcggcatcatcaacggccctcagaattctcagtcgaccatcgcccgttacggtggcttccttgccgccgcgcattcggcgcacatcgaacccgaccccaccttggagcgcgccacagacctgacaccccaagccagttaccaagcggcctgcgagttgttggacctgcctgagcgcccgagcgccatcttcgcttgcaatgaccagaccgcgctgagcgtctaccgggccgcccacgaacgggacctggcgataccgaccgacttgtctgttgtagggttcgatgacatttatccagccgagttcatggctccacccctgaccaccgtcaaccagcctttcaacgccgaagcccgcaaggccattgagatgattatcgatgtgcgccgcgaacgaccggtagagacccatgtggttttaccggtcacaatcgttaagcgcgacagcgccgcgcaagctgcggcaaagtaaagagtgaggtctcagggaattgaactctggcccgaacaaccatagagtacagcccggagaaaatctggccagccatccactggatacacttagcgggcaatcggtcggcggacgccgaagcaagtgtctacatcttattagcatctgcgaatcgtaagaccatcgggtaccagacgaccaggccccgtacgacggtgaatcctaccgacgaggttggcacgaggacatgatcgtgcgtgcattacccaggcggatgatagagatttttcatcaagtactgctgtttttagaagaaagcagggcgaagaattctcccgacacacaagcagaagggctcccctgatgaaaggtgaacctggagaatttcaaaacagcccaaccccagctgctctgctccggacaagatccacgaaatcaacgttagcgagtagaagcgcagctgctatatgttaataccgtcgttaatgatttagcgaaggagcgatcatgggcatggatgaggggagtgaaagccctcgtccttataagcgatgagagaggaacgaccgtgcttccaccggcggcagtggcgctgcgcacatcacagctccaccgcccaaaccgccacatatgggcaccgaggccaaaccgggaaagcccaacgtgaaggaaggcaaagcgaaccagaaacccgtactcactacgctactgctgctggccatcggctgtggcatggggccctgcagcagcacaatcacaagaactcacaacatgcgaagacccgcaatccgcctgctcaaagagccaggccgacctacactagtcacgcaagaaattgaaggacgccaaagacgaggcggacaaagccatggagaaaaccggacttatgtgacaaggcacagaccgagaagaaaaatagccgtgcagaccgcgcagcaacaggccgcttaacagcatgcacaagagcagcagatacagtcacaaacacgttctcagggaacgcctcaccggggctcattctgctccagggcaggctccaccggaacatccgaccgtaacggcgctacactgacctgcaggaccgcgacggacggccgcctgcgctggatgaactaacaaggagagagacaagcatgagattcggcatgaggaaacccggcgtcaaacgctcgatcagcgcacgcaccaccggcaggctcaaacgccaaatgaagaaagcgatcatccccgggtacggcaagaaaggcatgggctgggtcaaaaaccccaggaaagccgcctacaacaagatctaccacaagaccagcttcagcctctgggacctcttcaaataaacatctctaatcctggaaccccacttcaacagggccttttgttttactgacctctgtctgttttcagatatctttgtctttgtaaaacggccactagcaggaatattggcaggggttcacttattctcatgctcgaatttcatacaactcaaaaactcggtcaactgctagccaggtacggcgcatatcatttcatgagattcagtggacccgttatcattcttatatcgaaaagaaaagggaaagacatgcttaacaaagaggcgacgacggattactgggtcggcagacaacttgaagagaacaacatacagttcgaccttcagggaagccacgtgaaagagatcaacgaagcgttgaaaagcgcctcgaagcggggaacgaaaaaagttggacgacctgacgttgttgccattgttaatgatttcgttctggtcgtcgaagacaagaacactctttctaaacatcagaaactgactggaaaagatattctggatgacagcgtgaaggctatcaccgattacgcagtcaatggagcatgcttctacgccaaacatatagctaagcacacctctttcaagaaggtgtttgccgttggtgtgtccggcgatccgaaacatcatcaaatcagcccatactgggtcaatgacagaggagagttgaagaaactagatgacattgaatccttcgtatggttctcccctggtaacatccaggaatattacacacgctacgtgctggaagaaccgacacgcattgagaagaccaccgagcagatcctcaaggatgccaccgaactccatgagtaccttcgcaactacgggagtctcaaagaccaagacaaaccgttagttgtcgccggcattttgctagctctcgaagaaacagaaaatcataactttagcatagaatctcttaatggcgatcagaccccagagagccgcgacggagacaagataatgaaagccatccgagcaagactgaggcgatccaatgtcgggccggacgcgaaacgagacaaactgctttcggagttcgacatcatcaccaccagtttcagactcaacgaggtcaatgacacgttgggcatgaccccgttgaagtattacacgaactttctgaacgaccgggtatacaaaaacatcaagtaccaggattcttcagcagattacctcggacagttctacgggaaattcatgagctattcaggaggcgatggacagacactcggcatcatcctcactcctcagcacatttgcgaactcatgtgccggctcgtgaaagtgcgaccagacgacgtggtcttcgacccgacatgcgggacagggggtttcctcatagctgccatgcacatgatgatctctcaagccgaaacaaacacggacaaagaccggatcaagaccagacaactgcacggaattgaactgcaaagcaacatgttcgctgttgccgtcaccaacatgattctacgaggagacggtaaaagcaacatcgagtgcagtgatttcctgaaagccaaccctgcccagctgcaaacggaaaaaaccgcgacggtgggattgatgaatccaccatactcccaaggaaactcaggggaccccgaccagtatgagctctcttttgtggagcacctgctggactccctgaccgaaggggggcgtgcagctgtcatcgttcctcagtcaagcatgacagggaaaacaaaggccgagcgggcattcaaacacagcatcctttcgaaacacacccttgaaggcgtcatcacttgcaaccccgacacgttctatggcgtcggcgtcaatccggtcatagctgtattcaccgcgcacaaaccccatccaacggaaaaagtgtgcaagttcatcgacttccgtgatgacggattcacggtccatgcgcatgtaggcctggtagccgatgacgcagccaaggataggcaacaacacctgctggacgtgtggaacggcgcgactgaggcatcatcccaattctgcgtggaatcaaccgtgaaagaggatgacgaatggctccacagcttttactacttcaatgacgaaatacccacagatgcagattttgagaaagcgatcggcgattacctgacgttcgaattctccatgatcatgcaaaaccgggaatacctcttcgaggatggcgacaatcatgcaacgtcttgaggaacacacatggcaagcctttcgcttgggcgatatcgcagacatccgttctggtcgtgacatttatgcgggagaacgtagaagtggtgacacaccgtacgtaacatcaggcacagcaaataacggtattgggtatttcgtggccaactacaacgattcaattacatctaatgccatatctgtaaatcgtaacggctccattggagaagcgttttatcacccctatccagctttgtacggtaatgactgccgtcgcgtcatattgagggactacactgacgcaggaatccaactattcattgcgcatgccatctcgatgcagaaacaggcgttcagctatagcagaaaacttggcagtaaacggctgaccaatctccgtatcatgctgccggtgaatagttcgggcgcacctgatgatgagtacatggagaaatacgcacagcaaaaacaaaaagcaatgctcctgaagtacggagcttatgcggagcaacagatcacaaaaataggatcttacgtcaaggttccgaaactcaacgaaaaagagtgggctccgtttaaacttacaaacatttttgaagaaattagtcgtggaaaacgactgaaaaaagcagatcacgttcccggacaattaccttacgtctcatcaacagcgagcaataacggaatcgatgactatatcgaagccagcgccggaactcgtgtttttagaaattgcatcagtcttgcaaacagcggtagtgtaggaaccgctttttacgagccattcaactatgttgcaagtgaccatgtaacagcgttaaaaacagcacaatcatcgaagtatacatccttatttatggctacagtgattgcgaaacaaaaatcgaatttcaattttaaccgcgaaatcaacgacattcgtgtccacaacatgagaatcatgttacctgtcaacgactcaggcgaacctgattacgaatacatggaacagtacaccaagaatatgatgctacgcaaatacgagcagtacctcacatttttagaaggtaaaacacgaaactaaaaccacctcaatagccccgcttcagcaaagcttcttgcatctattcaatgctgagtgctgagtctagcttaagcatggcctgcctgcgctcgtccaggccggcggtccggcgcacgtataagcggccccgcttcagcggggccttttgttttgccgtcctacgttcgctttgttcccgcatgggctcagataagcattttagtatacatttagtatacatttgccgtcccaatcaatggttatcggcaatcataaaacctctgcaaccgttgtggttgcagaggttttaatgagtggggcctcaggggcttgaaccctggaccgaacgattatgagtcgtttgctctaaccgactgagctaaggccccacgctggcctcaggccaacagcattactttagcaagagcacttgtcaaagcgagcgctaagcggcacggcgggtcagctcgttgtaagcgggcaggcccatgtagttgaaggccgcgtgatcgattcggctgctggccaccgcgctgaccttggcgtaccacagggggatggccggcagatcgttcaggagctgggactgggcctggcggtaagtgtcgaaagcctgggcccggtccgtctgccgggctgcctgggcaatcagggcgtcgaatgtagcgctcttgtaatcaccgtagttgagccccttgccgtcagccgctgaggaggcgtacccctcgaccaagtagccctccgggtaggggtagtcggactggtgaccggagctgaacgccgagtggatctggcgtgcgttgaccgcggtcttgaactccttgccggtagggaacgtgttgctgcgggcttggatggcccaaagtctgatggaccgaattgaccagggcgtccacccagtccttgtcgctgccgtcggcagggtatgcgatttcgagtacgcctgaccacggcgagatggcatcggcccgcttccaaagctcgcgtgccttgccggcatcgtaggacaacacctccccgccgttcaaccgcttggaataaccggcaatcgtgggcgcagtgaagtcagtggcaggggtcaccgatcctcgaaacaccttgcttgccacctcggctcggtcgattgagcgcgatatggccgcccgtcgcaaggccccctcagccccctggaagtgaggcaggttggatgggatggtcagggatttgaaggcaggtccgggcttggtgaaggcctggacccgcggctcgctgcgataggtggccaacgaggagaccggtaccgcgtccaggacgtccaagttgccggcctccacatccgcgtaggcggcttccaggctctgatagtcgcggaaggtgacgccaccattgcgaaccttgcgggggccccggtaccccgggtccttgaccaggctgatcgactggttgggtgtccaggacttgaaccggtagggcccgttgccgattggatggcggccgaaagcggcgatgtccttataagccaccgaaggcaagggcaggaaggagacatcgcccaccttataggggaaggacgagtcaggcgcattgagctggactcggagggtggaagcatccggcgcgctcaggccggacaggatggcgtccttggacccgtgcgggttctgaaggtcctcataaccggcgatcgtggagaatatcgacccaccggtctgcccgttggccacgttggccgcgaacgaccatgcgcgcgcgtaggtcatcgccccaatcggctctccgttggagaagcgcaggcctggtttgagcttaatcgtgtaagcggaagcgtcctggttcggggtgatcgagtcggcgttcgcgtaaatcaggcgcccgtcgtcgccgaacgtgaccaaaccatcgaacaggagggtggccaacttccaaccagccgtgtcggtcaccttgcttggggtcagatcggaagagggctccacgttgttgaccgtgatgatcgcgttggaatcaacctgaccggcggactgacccgggcgcgtcgacgaggacggggacccgcaggccgtcagggccagggtcagaagggtcaccgaacttacagcactgactattgcagcacgcatagcgaagccgatcctttccatagtttcgttatcaatacgaccgttaattggcaggggacaccgttcatcgggcctggcacctccgcccggaggcgaaccggtccaaagcgcctgtcttcgcaatggccttgtaaagcatccagctgacgaaaccggcgaacacgattccgctgatagcctcgcagacagtgccgatcagcccccgcgggctcaggaaagcgacgccctgatagaagaacgccagcaggaaggcgttgtagaccagggccaccagcagccctgcggcgattgtgagcgacagggtccagcgacggtagcggaagatggcgtagaccacttcagcgcacaggccttgtatgacggcttcgaggatgatcatgcccaacccgtaggcgttgccgaagagaatctcgaccagggcgccgaccacattcgcgtagacggcggccccgggcttgcggatgatcagcaggttcatggtcaccgggaagtagaagaggccatgcagaagggaggccgcgcccggaaggagggctgtcatcagggggaagacccaggcggacagggccgacgccgcccagtatatcaaaccggagaccacgcccagggccgcgcccaccgctatgtcgaccggcctccagcgcagggagtgagatttaacggggatgggcgcgcccacattcgtattgttgttcgctgtcatgacgctccttgcgatccacccgcgcccctgcgcggcccgtgcgcacagtgccggctttgcgggactgccccgcgagcacccccttgacctgcgcacgtcggacggagccgctcttgagccactctagtctgccgaatcccggctgaacaggggtcgcgtgccctcagcgaactcggcggcgaacatcgaattcgtaacggtccctcccccggcccggtaaacgcgacgccaaggtccggtgccgcgcgaacggagaggctttgcgcgaggaggaaacgggcgaacctcgtcgcaagccccctctagcatggaagtagtgtaagaggctagaatttcaacattttcagtgaggtttccacttggctgagttcatctatcaaatgattaaagcgcgtaagtccttcggcgaccgcgccatcctggacgacgtgaccctgagcttcctgcccggggccaagatcggcgtcgtcggccctaacggcatgggcaagtccaccctgctcaagatcatggccggcctggagaccgtctccaacggggaggcgcagctcacccctggctacagcgtcggcatcctccagcaggaacccccgctggacgaagacaagaccgtgggcgagaacatcaagcaggccttcggacccgtcatggacaaagttcagcgcttcaaccaaatcggtgaggagatggccaatccagacgccgactacgatgccctgatggctgaaatgggcaagctgcaagaagagattgacgcggccgacggctgggacctggactcccagctggagcaggccatggatgcactccagtgccccgacccggataccccggtctcggtctgctcgggtggcgaacgccgccgtgtggccctgtgcaagctcctgctggaagcgcccgacctcctcctgctcgacgagcccaccaaccacctggacgccgaatccatcctgtggctggagcagttcctccacacctacaagggcgctgtcctggccgtcacccacgaccgctacttcctggacaacgtggccgaatggatttgcgaggtcgatcgcggacagctctacccctaccagggcaactacaccacttacctggagaccaaggccaagcgtctggaggtccaaggccagaaggacgccaaactggctaagcggctcaactcggagctggactgggtgcgctcctcccccaaggcccgacaggcgaagaacaaggcacgtctggagcgctacgagcagatggaggacgaggcccggcgcaaccagaagctggacttctccgagattcagatcccgccggggccccgcctgggttccaaggtcttggaggccgagcacatccacaaggcattcggcgaccgcgtgctgatcgatgacctgtcgttcacgcttccccgcaacggcatcgtgggcgtcatcggccccaacggagtcggcaagtccaccctcttcaagacgattgtgggcctggagcccctgacctccggcgatttggaggtgggcgacacggtcagaatctcctacgtggaccagaaccgcgagggcatcgaccccgacaagaacctgtgggaggtcgtctctgacggcaacgacttcatcgaagtcggcggcatcgaggtgcccacccgcgcctacgtggcctcattcggattcaagggttccgaccagcagaagccagcgggcgtcctatccggcggcgagcgcaaccggctcaacctggccttgaccctcaagcagggcggcaacctgctcctgctcgacgagcctaccaacgacttggatgtggagaccctggaatccttggagaacgccttgctggccttccccggctgcgcggtggtcatctcccacgaccgttggttcctggaccgcatcgccacccacatcctggcttgggagggcaccgacgagaaccccgcctcctggtactggttcgaaggcaacttccaagcctaccaagagaacaaagtgacccgcttgggcgaggaggcctcccgcccccaccgcctccaccgcaagctcacccgctaagggagggcaaccgcataaatctgagcctgcaggcagccggcgcgcatggctgcctgcagggtgcttgcagaccgtatgtttccgcctgcctatagactgctcaccagcgtcttatggggggtgggcaacaggctcggcgcgcgaaatagattccgttgggagaattacggcatgtcaaatcaaaacacaaccgtgggcgctgcggtggatgtcctttcactgcatatggaggaaggagccaacgatcccctccacctgaccggctccagcctccccttccccacaggtcgcatctacggcgggcagatcatggcccaatcgatcatggcggcctcttggtccgtacccaaggaccgcgtgccgaactcagtgcacggctactacctgcgcaccggactgctggatcaggatgtgcgcttcgacgtgcagaacctgcgcgacggccgctcctactccacaaggatggtggacgccagccagccggaccgggccatactcaaagtcatgctctccttccaagagaccgggcaggagggcgtgaaatacgccgatccgatgccggtggggctgcccgacccggagggcctgacctccgcccgggagctgatggccccctatgccgccgattcggctttcgccgcctactacgctgaacaatcccccttcgacatccgacacatcacccctacgatcatgctaggacccgaccaaacctcgcaggaggcggatagcggccggcagatggtttggatgcgcaccaacggccgagcccgcatgaaccagaccatgcagcgggccatgctagccctgggctgcgatcagctcatgatggaaccagccctgcgccgcaccgggctgtcaatctccacgcccggcatctcctacgcttcgatcgaccactccatgtggtggtacgaggacatcgacatgtctgactgggtcttgttcgtgcaggacacttcggttgcggaccacggcagggccctgtgctcggcgaaggtctaccaaaggggcgagctggtctccgcgatggcgcaggaagcgatgattcgtgtgcctaagcctgccgccgcggactaatcacgccgggactcagccctcagcggccccagcggcgtcagcaaagccctgatcggacatgcctttctgagcggttccagccaggcgctggcgttcggcccgccgcttgccctcagggctctcaggcccatcgttcgggggcagctggcagagccactccccgacgattccgatgatgatgtcgattaagcagaccaaggccgcgatcgcgcattcgacgatgacgcgctcatagtacggcgcctccctgtggggcaggcaggagagcccttgccccccataccagcccaagagggcggcgcaagccactcccagcgccttggacagcaggagggcgttgaccgcgaactgcggatccatctgcttacgctcccccttagcgtacttgtggacctggtaggccatcagcaggatgatcacgccggcgatcagcaggagggcggggaccacccagggggcgcccagcatatcgatccgcctatgctcgtcgatctgtaccaggcaggcgccgccaagcagccccagtccaagcgccagcaggtagtacacggccggcgtgcgtcccatcttcataccgaacctcccaaaatccacgaatcggacaccagagcgacctgctcataatcgggggcctcctgggccaggtcggccaccatcccgccgtggggtcccagcagctgcgcttgcggttctaaatcggcccacggtttgagcaccgtagcctgtcgccaggcttcctgatctggcaggaactggagggattcggagccttcgatcgccaaagggctgggttgagatgagcgcaggtcttccgcgctccatacgctgccatccatgtcgatcaggcgcaagtcgagggggtaggagtccagacgcaggctgcgggagcggccgtgagcgctctcaatcacccgtaaggccgacagaaggtcgagcgggcccataggggtttcgacgatcaccacagagcacaggagatcaccaccgcctgcgccctgggaccggtagaggggcgatatgccaatgacctggctgcccggcacaccgtccagggagacgatcgctgtgcgcatggctgattcaacgggccctatgccgccgctcatcgccactacggcccggtgggaggcagtcccaacctcaccgacctcagccgagcctccaccctcaccgttggggccgcgccggccgccagaggacgggtgctcatggaaggattgacgcagtcgggagcgttcgccggcctgcccggatgccagagcggctggagaggcctggtcgtctggtccgcaatcggctcgacgggtcaggctgacgctgaccccgtccatgtccacgcctgtttggcggcccgcctccaaacgatggaccgtcacctcgaccgaacgcacctggtgggacagcaggatggaatcggccacccgactggcgaccgtctcgaccagctgggcgtccataccctcgatcagggtgacgatccgccgcgccacctgcacatagtcaacggtctgggtcaaatcgtcctggctgcctgcggcgcttaagtcgaggtggagcgccacgtcgaccatgtaggcgaacgggcgaccatacccgctgcctcggggggtggcgcggatgccagtcaattgtatggaatccacgcggacctccctccacgggccgcgcccggcccacccttgggggcgaccggacgcggcggtattaccatttactgaccgatggccgactgatcgccctgaccattgacgctgcgtttcaaggactcgggaatctccaccgggggcaggtcggagtccggccggtcaggggcggacagccacaggggccgctcgggcgacatgaccaccttggagaaaatcgcggccagctcgttcttgcccaaggtctccttgaccaggagctgacggaccagttcgtccaggaccgcacggttctgtgtgatgacctgccaagcctcctcgtgggcggtctccaccagctggtggacctcctcgtcgatgaccttggaggtctcctcggagtacttgtggggcttgagagcgtccatgccctgatcctggtcgttctcgtcgccccacttgatcgcgccgagcttggaggagaagccgtactccagaaccatctgccgtgcgatttgcgtggccttctcgatgtcgttggaggcaccggtggtcggatcgtggaagacgacctcctcggccacacggcctcccatcgcgtaggccatttggtccaaaagctcgttgcgcgactgcgagtagcggtcctcggtcggcatgacggcggtgtagcccaacgcccggccgcgaggcaggatggtgactttggtcaccggatcggtatggtgcatggccgctgccaccagggcgtggccgccctcatggtaggccgtgttgcgcagctcgtccagggccatgccacgggtacggcgacgggggccggagagcacacggtcgatggcctcgtcgatggcccggttgtcgatcagctgagcgttggagcgggcggtgagcagggccgcctcgttgagcacgttcgccaggtcggcgccggtgaagcccggcgtgcgcacagccacagtatgaaggtccacatccgggacgaagggcttgcccttggcatgcaccttcaggatggcctcgcgcccctccaggtcaggggcctctacggccacctgccggtcgaagcggccggggcgcaggagggccgggtccaggatgtccggccggttcgtggcggcgatgatgatcaggttggtgtcgttgtcgaaaccatccatctccaccagcagctggttcagggtctgctcgcgttcgtcgtggccgcccatgccgccaccgccgcgcttaccgcccaccgcgtcgatctcgtcgatgaagatgatggccggggcgttcttcttcgcctcgtcgaagagctcgcgcacacgggatgcgcccaagccgacgaacatctccacgaagtcggagcccgccatcgagtagaagggtaccgaagcctcgcccgcgatcgcccgcgccagcagtgtcttgcctgttccgggagggccgtacaggaggacgccacgggggatgcgggcacccagggccttgtacttggacggatccttgaggaattccttgatctcctcgacctcctggaccgccgcctcctcgccggccacgtccgagaacttggtcttgggggtcttgccctccagcaacttgccgttgttcttcttgcccatgcccaacatgccgccgccggagccgccgatgcgggagaagaagtaccagaagacgaccagcagcaggatgatcggcaggaaggaggtcagcaggtaggacatcatgctggtctgaggcaccactgagttgaagccgtcctccaggtggcccatctccacggccttggtgacctgcggcccctggtccttgacgtagtagaactgcacgtcctggccgtagttcttctggctgcgcttgccatcgaccccgttgttcttcttgacgaagtcgctcttgagcttgagctcgacgacctgcttgccttcggtgatttcggcggacttgaccatcgtgttggtcgagtccttgtccttggagtcgaacttggccagcagttccaggccgtcgcgcgtgtcgatggtctgcacgccaccctgggcgttgaagaaaccgaacaggctcagcgcgatcagaatggccaaagcgccccacagccagggggactgccagaacttgccgccgcccggccccttgccgtcgccgttgagtttgaagttgaaggggctgttgccgcccggcttgccgcccttgcctggccggccgtcgcccgacggcgtacgctggggcccttgcggataggtcatgactgctctccttgatcctcatgctcgtattcctgcggcttcaagacagctatggagtccaggttccggtaccgctcgtcgtaatccaggccgaaaccgacggcgaactcgtcgggaatgacgtagccagggtatttcacatccacctggacctcatgcctgcaagtcttgtcgagcagggcgaagacctccaccgaggccgccccgcgggagcgaagctcgtcgaccagccagcgcaaggtccggccggagtcaatgatatcctccacgataagaatgtgccgcccgcgaacgctgcaatccaggtccttgcgcaccgtgatcgaaccggatgaggtggtgccggatccgtagctggacaggctcatgaactcaagctggaccggtatggtcaccgcctgcgagagggcggccaacgtgttgatcgcccctttaaggacggccaccatcagcaggtccttaccagcgtagtcttggctgacttgggccgccaccttactgattaagtcttcgatacggtctttggacaccaattcatggtcaatgtgggactggatatcagcgatgcgcatggtccctatctttgcatatgagaatgacgtgaccctggcgaaacgctgaatggaagctgggaaggctgactgggccttgaccatgccagcgggagacgagcgcgtcgatctggccgatccgacggctggacgcatccaaccccaagcttgtcaggagctgggcccatgcccgggaacgcaaggccgggtgggcgtcttgcatggtcttgacgtcaaggcaggccaggggctcagcaccttggggcttggccgtacgcgggcgaagggaccgggtcagcagacggcccgcctcctggtccaggaagtcctgatccgccctggccagcagagcggattgggccaggtgcatggccatatcgcgcccggcgaacgcgctcagggccggcaggaggtcgtggcggacccgggagcgcagcgggtagttggccggtaagcgctggtcggcggcgaattccccgccgttgctgggatcgtcccaccaatccaagcccatctgccggcagatggtggtggtctgggaccggctcacgtccaaaaggggacgcaagtagaggactcccccgcgccgggagcggggcgccatgccagccagagcccctaatccagcggtgcgtatcagggagatcaggacaccctcggcttggtcgtcacgggtatgggccaggagcacggccctggccccagcggcgagcgccacccgtccgatggcctggtagcgggcggagcgggcatcagcctccatccccgccttcgtatgagtcacctggacgcgctcggtcaccaccgggtccaggcccaggctggaacagcggtgcgcggcttcgccagccacctgggccgaaccctcctgcagcccgtggttgatgaccacggcgccgcacttgagccccagctccgggcagacgattgaagccagtgcggccagggccgtcgaatcccgcccccccgagcatgccaccaggatcaggggggcgtcgggagccggactgtggctaccatgcttagcgaaaccagcgccttgccggccaagtccagcctcctccaggcagcgacgcaggtcgccgaccccctgccgtaattcaggcgaatagaccatgctcagcctcgctcacagctggggcagaccggacagcagggtgtcgacggccttgaccgcagcgcccatgtccgaagggttgttgacgatgaccgcgaagacgagcaggccaccgcgcgtcctggatacgttgccggtcatggctgtcacctggtccaagctaccggtcttgaccctggctaggccgctagccggcccccgcccgcgattggcggccgtgccgaccagacccgccaccgaaagaccctcgaccaggggggctaaacgcccgtgacgaccgtcgcaggccaagcgctggacggccgccagtgtggtcacgctgacctgcgagcccggcgagaggccggagcagtcggccatgtgggcaccgccctcaagcttgatcccctcacgttccaaggcctgcccaacagcctgcaccgcgccctcgggcgagttctccttgccctccttgatggcggtcaaccggccgaagagttcagccagcgtgttgtcggaggtacgcagcatataggccatgatttggatcaggggcgccgactggacctgagccaagggttgatcggcctgcgcggcctggcccgccgagggctcgccttccaagtcgatgccctgctcacgcaagcgctgggcgaagacccgcgcggcctgaccttccggatcctggtcgtgcggcacatacacgccagccgcgtccggcgcggcgtcccggtcctgcggcgagcgttgccgcccctcatccacagccatggcggaagtgggcgtgaagtagacgcctcctggattgttggcttctatgccctgagacgagcgcacggagccgaacttccccgcgtcgtaagccaaggacaccttgctgatggaccgggccttcaggacttgggcggtctcctgggccaaggtccctaagccggcccgaccgttcacatggttgggatcgctcgccccaggccccagcagcatgtctccttggcccttgagcgtcagtttcgcgcccgcaccggccgactggctcagataggcctctgtagggatggtcgagcccatgtcaaggctgccagccgcggccgcggcggtcaaggtcttcagggtggatgcgggctggcgcaggttctcctggtcacgctcggcggcgacggttccgtccgcgtcggcgatcaggaccgaataatcggagcctaaaccaggcgtggccgcgaacgtgtcgatgactccctgggcggcggccgcgtccacgccccgaccagtctccaagtctccggccacacgcgcaggggcccaggcctgggctggccctgcggcctggccttgggacggccgagcgtccctggtcaagggtccagggaccaggtcggcgatgtcggcggccacgtagccagcgaacgcgacgacgaccaagcccgcggccaacagggtcctggccacatgacgctgaggtccgcgcacgtgtgctcccactcttgcctccaaccggtccgtcatccacagccgccgagcccttgccggggcctcggtctcctatctgcccagcttagcggcgggcaggaccggacgcgccactggctcactggcccgtaggaccagcaggcataggccgtcaatcaccaccccggtcgtcaagaccggcatgcgcttacgccttaaacccgatccaggagggaagcgaatcggaagagccgaaagccccgtcgcggcactatttgccgttgtgctcaatgggcttccagcccgggttggcgaagatggcctggaaggagatgggcacgtaggagagcatgaaaatagggaaggaaaggcagtaggcgaagagctccttgttggaggcgccgatcttgtcgcgttctgccaccacggtcagggcggccaggaccatcatggccagcatgcctcccagcgtccaagcagccaccttgatcaacccggtgatctgactggcccaagtgacgaagccgaagacggagaacaggacgccaaagaccgcacgcgccactgacaggacggtcagagggcaaatcaggatggtcaggtccaccgcggagaagtcccgctcccggaccgccctcctgatcagggcgggcccgtaatagcggaagacctgcaggaagcccttggaccagcgaaggcgttgccgccaggactgtttgaaggtcaccggctgctcatcgtagaggatggcggtgccacagtagccgatcctgtcgccgtggaggacggagtccattgtgaactccaaatcctcggtcagcaggtggaacttccagccattgttgcgttccatcacctcgcgggagaacatgaaaccggtgccgcccacgtggcaggaggaaccgaagaccatgcgcgaggagttgaggaagcgggattcacggatgaaccacagggccgagcccgaggagacccagttgtcggagaagttgaccgagtttcggtaggaggtcagaatcttaaagccggattggaaggctttgttcatctcctcgatgtagtgcttgtccaggcggttgtccgcgtcgaagacgaagaaggcatcgtatcggttggaaccctcgcctgcgttgatgtggtccagcaggtaggacagggcgtaccctttgccgatctgctcctggttttcgcgctcgaccacatggcaacccttggagcgcgccacctcggcggtcccatccgtgcagttgtccgcaaccagccagatgtcgatcagccgcgagggataggtctgggcctggatggagtcgattagggagcccaccacatgctcctcgttgcgggcggaaatcagcaccgcgaaccgccggtccatcgaggccggcgggaagacaaccggcttggccacgaaggacgtgacaacgcagacggcctggtaaacgatgccgaccaaacccagaaccagcatcaaggcatcaaccacggaaagaaaagccattcagcgccactccttacgcgggttggccgcgctctcgccgggcccgccacgttcagcaccgtcctccttgcgcccggagtcgccgctgggctccagcgtgggcttcccggaggcggcggagaccagatgcttggggatggccacggtctgcgaagaatccaaggcctcggaagtgggcatgtggctcagctcatccttggcccgctcagtgtagccgtcagtgggggccacccgcttgctggaaccgcgcgcctgccgggggatgtggtcggccatcggtttgatcacgtgctcattgatgacctcggccccctccaccactttggatttcttggtgggccgagggtcgttcatcagcggggagtcgatcaggtcgtaacgcttggtggaagccttgaagatgatttggaaggaagcggcgaccggcaaggcaaggaaggcgcccaacgccccgaagaccgcgcctaaggccaggaccgagaggaaggcgatggccgcgttcaaatccatggtccgttgggagatcttcggcgcgaggagcagattctccacctgctggtagaggcagatgtagatcagcaccgccaacgcgatgaccaggccgttgccgccccaggccaccacgaccggaagggcgccgccgatgtaggtgccgattgtcggcacgaactgggagaccaggccgcagaaaagggccaggggcagccagtagggcaccttgagagcgaccaggaagaccgacatgcaggtcgcggaaatcagggccagaatcgtgcgcgagaaaaggaaggatgaaatctgatcctgggcgatggcccagaccgagacgaaccggcgctggctggacggactcatccactggcatagggaccggcgcagcttgggcccagcggccgaaatgtagtacgtgaccagcaggacggtcatgatgttcagcaccgagcccaacagccccacggtggtcgaatacgcctggcccgcgaagtcagtgacccaggaggattggatgttgccggcgatttgaccgcccaggtcttgcatggccggcagctcctggtgggtcttcgccttgaccaggccagccacctgctcgtagaaggcgggcgcccccctgaccatgccaatcacctgctggacgaacatgttgccgaacaagcccatcaacgcgatgacgaccaccaccaggccaatcagcgtggcacccgaggccgcgcccctcttccagccgtgcttgaccagcaggacgaccaggggctccagggccaaggagacgaacgtggcgatgaccacatccaggacgacgaactccaccttggaccaggatgcgtaagcgaaccatgcgaggaagacggctatggccgtgtagagcaatgctcggccgaaccattcgggtggccgccgggggtctcccttcgaggggaagaccgatcccaagtcgaactgctgcttcttgctcgcgctcatgcctccattatcccggtcttgctgacaaggcgggcgcccttgcccagccggtgtagcccggggcaagtattgtgaagcctatgctgaccgtttccgttgtcgttccggcttggaacgaagaagaacgcatagccgactgcatcttgaatgcgaccacccagtcggtcgcccccctcgaagtgctcgtcgtggacaacaagtccaccgaccgcacggcccagatcgtgagcgacttcatcgacgcccaccccgacacccccgtcaagctcctccaccaggacaaggagcaggggctgatccccacccgcaattatgggttggaccgggccaaggggcaggtgctggggcgggtcgacgcggactgcatgctgcggcccaactgggtggaggtggtcggcaacctcttcgatcgcgacccccaggccatgggggcgactgggccggttgcctattacgacatgcccgccaaagagctagggctcaagggcgacaacaaagtgcgcaaatcggtctaccgggccgacgacggacgctacctgctcttcggctccaacatggccctgcgcgccagcgcctggaaagccatccggggcgaggtctgccgggacaaggcggacatcatgcacgaggacgtggatatctccctccacctgatcgaccacgacttcaagaccgtctactgcaggaacatgaacgccggcatctccgcccgccgcatggacacgtccttcccctctttccgccggtacatgcagcgtttcaaaaacaccttcgacgcccatccccagcacacgcgcgagcaaaagcccgagcgcaccctctacgccatctaccctgtgctgcgcgccttctatcccgtctaccagaagtacctggaatcagccgacatcaacccggccgagcgcgtctggatcaaggagcagatggagctcttccaccagcgtgaacaggagatgtgctgacccgcgcctctccgagcgtttgcctcgtctaggggtggcgggtagtatggcttcgtccggccccgtcgtctaacggttaggacaccagactttcaatctgacaacgagagttcgactctctccggggctacgaggttttcgcttcccgggcgcgccgcccggtcccacaaggattcgtgcgggcgtaccagcccaggcgcgccgccttttcgcacacgatacggccggccaacgaagcaccggcgaaagcatgactgtcagaagcagcctccccctcatctgaccccaccgcctgcgagcgctatggggaagcacagcctgaacgagatcatacggcgcaatccttcccactgctatcaagcagtaaggcttgggccgccgctaatcggaggagcgacatgagcgagcagaacgaacccaccgtccagaaccagaccagccagcaggcagcgagcgccctgcaggcggagagcgagcatgtgacccaccacacgatcaccctggacggcaaggaatgggcctacgacgctactgtgggcaccattacgatcgacaccgccacggtgaagccggcggcctccgtcttcttctccgccttcaccgtggtcgacgcccaaggcaatcccgatgccaggcgaccagtgaccttcatcttcaacggcggccctgggtccgcctccaccttcctgatgatgggctcggtgggccccaagcgcatcaacatccccgacgccgtgcccgaacccgcggccccgtacgacatgcccgagaacccggacaccctactgcccgaatccgatctgattttcgttgacgcgcccggtgccggcttctcccaagtggtggaagaagccaagaaggagctgtggtcagtggacggggacgtgcgcgggttctccgcgttcatccgcgcttggctgagcaagtaccatcgttggaactcccccaagtacctcctgggcgaatcctacggcaccacccgtggcgcggccctgtccttccgcctgcagcaggacggcatcgccttgaacggtctgaccttactgtccaacatcctggattacggcttcaccttcgacacctccgaccagtactacatcggctacttccccacctatgcggccatcgccaagtaccacggcaaggccggcgccggggtgagcatggatgagcacctgcagcaggcgcgcgccttcgccaatggccccctgcgccaggccctgtggcggggagaccaactgggcgccgccgagcgcgagcgcgtggccgcacgctacgccgagttgaccggcttggatgcgcggtacgtaatcgattccaacctccgggtcctggacgaccgcttccgcaagcagctcctgcgcagcgaggacagcatcgtaggccgctatgacggccgcacccaaggactcgacatggaccgcatctcggacgtggagacgttcgtggtggacgataacttcatggaacctccatacaacgccctgggcaacgcctacctgcgcgacgagctgggatgggagggccgtcctgaacgcaagtcccatgcaggtttcgagtggggagccacagaaccgggcaagggctgggtctggtggcaccaactgccgccacgggccatctcctccttcggcgacaagacgcccttccccaaggtcacgcccgacctggccaccgccttggtccgccacccacggatgaaggtcctggtctgcaatggcttcttcgacctggccacgcccttcggccagaccgaatacgacatcgaccacatgggcatcgacgcctccctgcacgacaacatcgccttcacctactacccggccggccatatggtctacaccaacctggagagctacaagaagttcgcccatgacctcaagcacttctacgccgccacccccgaggacatgcctgagatcaacgagcgcccctcccagcccacagccgacgagatgcgctgaggctcttcttctataggcggaccccggcagtcgttgagttcctctgccggggtcctcgcgtctttacctgcatggccaggcgatcgagacggcgcctgcccgaaccgctcggcggcttacaggtacttgccgcccggcaggtgcatgaaatcggggacccggctccacttgaccgggtagccggcgccgtgggcgcagaagaccgagtccggggtgttctccaagtcggcctcggggtcgtagttacgggcagcgatgacggcatcggcgtcatggcagggccggtatccgtccaccaggcaggtcagctgaccttggccgtgggtgtaggcggtgacatcaagcgcataatcccgcatttgcgacaccggggcgctgcctgtcacaaccgcgtaatcgccctcgctgtcgggcgcgtcaaaggagccactcatccgctgtatgtcggacatggcgcggcccagctgctcctggggcagctccagccggaaggagtaccagggctccagcaggacattgcgggcgtgcatcagcccctggcgaacggcccggtaggtggcctggcggaagtcgccgccctcggtgtgcttctcatggccccgggcggcgaccagggtgatccgcatgtccgttatcggagagccggtgaggacgcccaggtgctccttttcgcgcaagtggcccagaatcagccgctgccagttgcccggaaggtcatccaggctgaccgctgaagcgaaagccagcccggacccaggctcggacggctccatgagaaggtggacctcggcgtagtggcgcaggggctcgaagtggccaacgccctcgaccggcgcggcgatggtctccttgtagagaatcgacccgggcccgaagtccacttcgaggccgaaccgttccttaagctcctctcgaaccacctccagctggaccttgcccatcagctgcaggcgcacctgccccagccgctccacccagcgcacgcgcaggagcgggtcctcgtccgccagcaggcgcagggcggcaagcacctggtgaatattcgcctccccgggcaggacggtgtaggtcagcacagactctgacagcggtttaacgccgtcgccctgcgcccccagcccctcgcccggatgggtcgtgtccaaccccgtcaaagcgcagaccatcccggcttgagcgtggttcaccaggctgaacctagctccggagtacaggcggatttggtccactttctcattcgcgtcccgcgccgcgccggtcagcatggctttgaccgccagatcccctccggtgactttgatccaggtcagtcggccaccgtctttgtcatgggagatcttgaagaccctcgctccgaaatccagccctcgatcaggttcccgggtgtaccggcccagtccttccagcaaatcctgaacgccgtccaagcgcagggcggagccaaaatagaccgggaacagccgccggcgggcaatcaagtcccgcatccgcccatcgctgacccgtccctgctccaggaactcctcaagggccgcctcgcttaagagggccgtctcctccaggcgcgcggggtcagcgccggcggagcaatccacaaagcccttccccaaccgcttgcccaactgctccaggagggcttggcggccggcctggggcgcatccatcttgttgacgaaaacgaagacaggcagcttgtaccgctccagaagtcgccaaagggtctgttcctggccgcggaccccgtcgggggccgagaccaccaggatggcgtagtccaggactcctagggtgcgctccatttcggcggagaaatcagcgtgcccgggggtgtccagcagggtcatggccaagtcgccatgctccagaagggcttgcttggcaaagatcgtgatcccacgctctttttccatgccgtcggtgtccaggaaggcatcgccgtgatccacccgccccagcttgcgtatacgcccggtctggtagagcatggcttcagccagggtggttttgccggcatccacatgagccaggatgcctaagacgatgcggcgcgggcggtccatctcctggttcatagcccagcgaagatctcacccggcctgtggatggccccaagccggtccaggggccaataggtccagttggcgatcgcttcgacccgccccaagggcacctgacctccgttcgcgtcgctcatatggaagcgggagtcggcggagttggaccggttgtcgcccatgacgaaaatgcaaccggggcgcaccttgaccgaaaacgggatttgcgagggcaccgcccccggcatgatgtaggaagactcgttcaaaggcttgccgttcaccacgaccgagcccgacccatcggcggacacgtggtcgccggccacgccgatgacccgcttaatcaggtagtcgtcgcccgggccggtgttgagccagcggtccgggtcgtggaaaatcacgatgtcgccccgttggaccccgcgcaagcgcggctggagcttagaggcgacgaccctgtcgcctacgttcagcgtgggctccatcgactcggaaggaatcacgtaggctccaaagacaaacatcctcagcaggacgaccgccagcacgcaggcgaggagccaagcagcatcagtcagcaacctcctgcgcaaggaaggcttgcctgggttcgtacgctgattggattgctcctgaccctccgcagggagccgctcaggcttcgcatgatccctatccacgctccaccccttcctcccgccgcaggcgccgccccgccagctacttaaagacaacctcagtgtaatgacccccatctaccgtcttccacggtcccacagggctctccctccgccctgcttgcaggtctcgagcgtgcacctagcgcggacgaagttctccgtccccagcgcggacaacctggtaggtcaaatcgtggatggcgcggccagccaccagccccttgcgctcgaaattggtcaggatccgcccagggaagcgcgtcgattcaaggaagtccgcgtgcggcagagccgcggcccgctcggcggtacctttgcccacgtgctcgatggccaggctgacccgctcgtcgcccaggttcctccaagccgggtcagcgtccatgacctcatgcacgtgcagggcgtagtcgtcgatgtcggtggcgatcctccacaggccaccgggcgtcagagcccgggccaggtcagcggccaaggcgggttgaatcaggcgacgtttgtggtgcttcatcttaggccagggatcagggaagaacgtccacgcctcgtccagggcccccgggccagccgcggagatgaactcggtggcgttggtcctcgccaggcgcaggttgctcaggccctgcttgcccgccaggagcatcgtatgggccagaccaggctcgtagacttccagggccaagtagtcgcgctcagggtggtcggccgccgccgcaacgacattctccccctggccgctgccgatctccagcgtcagcggggcgcgacggccaaaggcggtttccaggaagccacggtccaccgtcagccccgggtccacacccaagcccgctggggcctggtccagtttcaggaggtaggcggcggagtgctcactccaggcgcgggccaggcgggcgtcaagtttgcctgagcgccgcatgaatgagacgatggttctgcgtccgcggtcggccccggcccgggtgcgcgcggcgttctctagagtgctcatcactaccatatatagccgaaggaaggtataagagggccgccgccagccggctcctccggcaaaagcatcatgctatactttatttagaacaaatacaaacaaaaacgtgcaaaagcgaacatcctctgtcagggtgcccttttgcaggaaggtggtaaaaatgtcggtcctcgtcactggcggctgcggttacatcggagcgcatgtggtccacgcccttcaccaagccggacaggatgtcgtggtcgtcgacgacctgagctacggcaaggcctcgcgcatcgagggcgcccgcctgtacggagcggacatcgccgcgcccggcgccgacgagcgcctggccgaaatcatccgcgacgacaacgtggactcaatcatccacttcgccgcccgcaagcaggtgggcgaatcggtcgccaagcccctgtggtactaccagcagaacgtgaacggcatgctcaacgtcctgaaggccatgtccaccaccgacgccaagaagctggtcttctcctcctccgcctccacctacggcgagcctccggtctcggtcgtgcccgaggacgtgcagccgatggtgccgattaacccttatgggcagaccaagctcttcggcgagtggatggcccgggcctgcgagcagccattcggcatccgcttctgcgcgctgcgctacttcaatgtggccggttgcggccccgtcgagctggaggacccggccatcctgaacctgatccccatgctcttcgaccgcctgaagcagggcaaggcgccagccatcttcggcgacgactaccccacgcctgacgggacctgcatccgcgattacatccacatcaccgacctggcggacgcccacctggcggcgctcgcctacctggaccgggaccagcgcaggtacgacgccttcaacgtcggcaccggcaaaggcacctcggtgcgacaaatcgtggacgaggtcaagaaagtcaccggactgcccttcaaggaggccatcgagccacggcgacccggcgacccggcccagctcatcggctcgcccaagcgaatcaacgaggagatgggttggcacgcccggttcgacgtggaagacatcgtcgagtccgcctggaaggcatggcaggccaaccccgaccaccacatcgatacggacgcttggaagcagaccaactgatttcctgaccctgcccctccactagccccggtgcgcgagccgcctcgccaccggggttttaccgacccaggcctaatctgaaagtatgagcaacgattggcgcaaccagccgcaaaccccctacagccaagacccctacccggcccagtacggccagccccagaacccgcaaggcggccagggggccatgcctaccgatcccgccaacccctacctggtccccacccagcctccctatggccaggcgtacagctccatgtcaccggcgacgcggacgagcggcgtagcgatcgcaggcttcattctttccttcatcctgcccctggccggattaatcgtctcgatcatcgcctacagcgagagcaagcgcaaacccgaccagaagagcggcatggcgatcgccggcgtcatcatctcagccgttggcctggtcttgcggttcatcgtcctgcttttcgtcttcatgacggtccaatccctatccgaattcagccacggcggctaccattccgacagcatcacggccatggcctgcgccgttcgcgccaaaggcgtcctctgacctcaaggcccggcaaggctggcccgccaaggcagcgggcagcgccacgagcgcgacgcgccgtaggcttgcataagcggacagttcatgtaaactaatcacttggctgttaaagcagccacggctccgtagctcagttggttagagcgccgccctgtcacggcggaggtcaccggttcaagtccggccggagtcgctgggttttcagccttttcccgctgatcccaaaaattcggaaaacatggctctgtagctcagttggtagagcgagcgactgaaaatcgctaggtcaacggttcgatcccgctcggagccaccagcaagaacccctcccccgcaaccatgcaggagaggggttctgcgcattcgcgggcccctcagcgatcacacccgcttgagcacccagtccacgatgtagggggcggtacgctctatctggtcgatcgcgagctcgaaatcctgggggccaccgtaccaggggtccaccaggtccaggtcggactcatgccctggccgaggctgaggcaagtccgggtcgaaggagcggtagaggtggacggccgggcgcttatcagggggcaggatgcgcaacaaggcgcgcatgtggtcggcggtcatcggcagcagaaggtccgaacgctcggcctcctcccggctgatccggtgggcgaaatggtcatccggcaggtcatagccacgttccttgagcaccttctgggccctgcggtcgattggattgccgaactcctcgtcgctgactcctgaggactccacacgcacccgatcgggatccgcccctcggtcttggaaaaacttgcgaaggataatctccgccatcggcgaacggcaaatattgccggtgcacaccgtcatcaccacatagggcatacggtccccttgcatccttatgaggcctccttcatctgaccttttcataggtgacgtaccggaaacgcttgacgccccggtcgcgcggatctacggcttgctgccaggacccccgctgaccgaccctccagaaacggtggcccgccagttcgtccatgtccggcgcgaacgtatccgcgtccacctgcgcgtccagctccgtcacataagcgcggtcagccagggaaagcgcctcttggaaaatgcgggcaccgccgatgacccatatctccgaacggtcgatcccatctgcgggtatggcctcctggcgggccatttccaccgcgtcctgcaagctcatcatgaccgttgcgccgggcgccctgaagtcagggttgccggagatgacgacgttgtccctgccaggcagcggcttggaccccatggactgccaggtgagccgccccatcagcacagggtgggatatcgtcagttccttgaagcgcttcatgtcctcgctcagccgccaaggcatccccccttggtagccaatggctccccgcttgccatcgttggcacgggcttgggcccaaatcaggttaatcgaacaagggtcggagagattgtcctcctcaaactccttgcttttatcccccagcagcccggcatgaccgggctcgggttcgtgatagccgcttttgctgctactgtcatgctccatagtgtcgccatgctcctctatcagggatttgcaacaatatactactgactagctcagaccgccaccggcgctttgatggtggggtggtgccggtagtccagaatcttgaaatcctcgtactggtagtcgaaaatcgactcggccttgcgcatctcaagacgcgggtaagggtagggttcgcgggagagttgctccagcacctgatcgatatggttgtcgtacacgtggcagtcgccgcccgtccaaacgaattcgccaggttccaagcccgcctgctgggccatcatctcagtcagcagggagtaagaggcgatgttgaacggcacgcccaggaacatgtcgcaggagcgctggtagagctggcatgagagcttgccgtcggccacgtagaactggaagagcgcgtggcagggaggcagggccatctggtcgatttcagccgggttccaggcggtaacgataatgcgccgggagtcgggattgcgcttgatcaggtccaaagccttggagatctggtcgatcgtacggctggggtcctctggggtgggggcgggccaggaacgccattgaacgccgtatacaggccctaactcgccggtttcggaatcggcccactcatcccagatatgcacgccgcgctcctgcagccagcggacgttggaggaacccttaaggaaccagagcagctcgtaagccagccccttaaagaagacggtctttgtggtcagcagggggaagctcgaggacaggtcgaagcgcatctgctggccgaacagggaaatcgtgccggtaccggtgcggtcggacttcaaatggccctcgcgcaggattttacggaccaaatcctcataaggagtagggatgtcggtctcgggacgttgtggaatgcgggtgcgaatctctgcgagctgctgctgagtcaaagccatgcgaccaagtttagcaagtcccaatccgcctgcataggcccccaggctcgaagcggatgacccggcgcttgtgaaggcctgcggcggctgagcttcctcccccggctcaatcgggcgcatccgcacggattcagacccatccgcgcggcgtttgggggtagattggatatgtacacacacgagcattgagaggtagctatggcgaaaagactatgggttgagcgtggcgccgatggcgtctgggaaggccattcggacgatggcgccatgattaggttcggccggggagaaggcctgttcacccccggtgatctcgtacaactcgctctggccggctgcgcgggcatgtccagccagttcgcagtcgagcgagccttgggcgagggcaagggggccaaggtcgtggtcaacgcccgctacagcgacgatgacgacgccttcctgagcttcgatgagcaggtgaacctggacggctccgacgcccacctgagcgatgaggacgccgacaagctggtcgagagggtcacgcgccacattgacaagtcctgtacggtcaagcacacctacgagcgcgaaactccggtgcggatgagcgtcaacgtgcgccgctgagcacaccgacggagccgggcttaccctcggcactcggacgcgagaggggccgtccgccaccagtttgaacaggtggcggacggcccctcgccgttgtcgcctcagtcgggcgactagtcctgatcgtcgtgcagcgggtcgatggcggactcgatgtcctccacccccttggccttagcgaccgagacctccttcaccccgttgatgtcctccagggtcggggtctcaccctcctcagcgctgaaggtagccgtctcaagctcggactcgctggcctccacgtatttacggggcaccacatagaccggggagaccgcatgctggaggaggccctgactggtcgagccaagcagaaggccagtgaagccgccacggccgcgggacccgacgacgaccacgtcgtgatccctgctggcttgggtcagggcctcaaccgctgagcccggcacgaccttcttgtcgatcttcaggcccggatacgtctgctggaggggctggatacggtcatccaagtcctccaggtaggagtccatcacactcttctcctcggccgaacccgtgccggtcaggccggagatgttcggcactgcggaaatcacgtcaagagtggcgtcccagttagcggcgaactccgccgcgatctgaagggctttgagaccccacttggactcgtcagagccgacggccactttcctgatctggttgttcaagtgcatgagattgccgtcgtcatcggtgtagggcaccactacgatcgggcagtaagcgtacgcgggcagggaggaggatgtggtgcccaacaggcgctcggccaagccccccttgccacggttgccgatgacaatcaggttgtagttgcggctcagctccacgaacaccgaggaggggtcaccggtcacaatcagcgtgacggcctcgacgccctgctcatccgctatggccttggccttcgatagaatctcctgcgcgtccgaatgggcggccgcgtcatcgcccatcgtcgtgtaggtagcgtcgaaggacacggctgcgtacgagggcagcgaatacgcgcacacgatttgcagggtcagcccggcgtgcttggcgtagttagccgcccaccaggtggccttgtagctggcgtccgacccatccacaccaaccagaatcgccttgtcgttgatcataacgacctcctcatgactcacggggccaggccaatggacctcgcctctatcttgccttaagaatatcgcaccaggagcagccgataatccggttcatcctcgtggcgtttcgtccatcttcgtccagacatagaggaaggccccctcgggagccttcctcaagatccgaatgcctctaccttgagccggcagaagtcgctatagcactcgataaaaatcccaaccgcctggattgtaaatggcttgtattttaacggactgtcccggctggggagcgtgaatcatgctgccaccgctgatatagatggcgacatgactgccatctttagcaaccatcaaatcaccggttgaaggattagacacttgttgacccacgcgctgcgcattagctatgcgcggcagattgatgccgaagtgggcgtaaacgtaacgcgtgaagcccgaacagtcgaagccttcatctggagtattaccgccgctcttatagggtatccccagaaaagtcgtggcataatccaaaaccgcctgaccactggccgaagccggagcatccttcgagggcaaagcgctcctgctggccgaacggctgaccgacaaagatcgctgctgagaagccgctgcctcctgctgggcctttttagcgttggcctcggcctgcgccttgacctcagcatctttttccgcctgggacttagtctgcggcacattcaggctttcaatgcctccccagttgctgttggtatccaccgaagtagaagtggactcagcaagaagattcttgcgaggctggtcagcggacctgaaagaacgggaggaagtcacggttgccgcagaagactgcgtgtccgcgaaggcgacggccgagaagcccgccagcagcgtagagcaggccagcactgatgcggccgctgtagtccatgttttccgttgaatgttcattatctcctcactctaccacaaggcgaagaaggcagcggcgacggtgccggaacccgtggaatcagtaatggacgaactggaagtcgtggacgtttttatacgtatgggagtaggtcttaccgcccaacgagacgccgcactcagaggtggtgatcgacccgtcggggttgatgctctccacgatgcccacatggccgtaagtagggtcagtgccctcctgacctgcgttgaagacaatcacatcgcccacattgcgcggggtgttatccacccagtagcccagagctcgggcggaggcggcccactggcagccattgcccatatgggagccgaccggcaggcccaactggtggcggcgcacgtaagcccaccaggtgcattggctgaattcgtaaacgttgcccgcgtcgccggtggaatggttagggttgaagttggcgggcaggaccgcctgattctggtccatcagcttggccacgaccgggttgtcggccagggacttgaacatgctggacacgtccagactggaatcagccaactcccacgtgccatgattgctggtctgctgatcctggccttcaggcacgcggacctgcgaacgggagacggaagaaccaccatccacacgcgctgaagtgaacgaggatgtcgtcacttgcgaagtggtggggtcggcggccaggggcgccttcagtggactcttaggggccacaacagcgaccgcgccagcggcgacgcctacgagcgccgccatcgtggaaccggtcatcacatggttcttccgggccgccgccttggcggccaaccgccgggagcgacgtgtcatgggcgccacttcattcaaccgctgggcaagggcttcttccacagcggtttcctggcgcatcttcttggactgggcggcgaatacctgggagacgttcacgatcccgctgccgcgcttggcctgggaggaaaccgacgaagcgcgctgtcgattgatatgcgcacctcggacgattttcgccttgtccgcagcgaacctcatatacgatcactcctgtattgtttacattcctaataccgcaacgtcacacaaccatcacttactgcactttacaacagtatgcccgcgaccacctaaccgtccgatattgtccataccgccccgctcactcgtcctgacgctcatggcggcccttggacctccccggcttttcgggccccagcgctattcggcccacgcacgcccatccccgaacctggcaagctgagcacggcgtgtcctctcgctaagagcgaggtggtacgaatgcttcgtgaagaagccgctcatcgaggagtggaggccatcaggaaagagccgtggtcgtcggccggggaaccgtcgagggtgctcccgccaggctcgggccgcacgatatcgacggggccatcgtcggagcggatgaagagggattggccgtggttcaaggtcaaatcctggttctggccgcgcacgcgcacactgccttcgacgcacaccagcacgcgagggccggcctggggcagcaggaggcggcggggaccgaagcgctggaccaggtccccgtaacggtcgacgatcctgctcatcagcggccaggtggccgaaccaggctccatgtacccgtagaccagcatgtattcgctgatgtgggggcggtaggtgaccatgttgtgcatggccagggtcgcgatcatcgagcttgatgggtcaatcgggctggcgggctggcagtccaggctgtgcaggaggttggccaggtccttgtgcttgggggtcatgcctgcgcgcagcacattgtccgaattggtcatgatttccgccgccgcgccgtggatgtatgcgtggggggtgcctgctgggatgtaaaccgattcaccctcatccaggcagaccgcattcatcatcagcaaggccaggacggaaggatctccggggaaggcttgcgcggcctgaagggcgttgactatggcatcatgcgccttgcgcgagtgaatccgcctgtcggcgtccagcagggccggggtcaattcgcccgcatcacccgcctgcgcgctgaccgccgtatagaaggcgcggaagacccggcgccgggagtccggccacgccagcgaggagacgggcatcatcgcatccgcttgggcgaaacctgccggcgtggttccccggcggaacctgtgggtcactagcgcgtccaccatccgctgggcgacaggatggtccaccactctcaaaatctgcagctgcgtggagatcggcgcgaacccgaccgatgccgtaaaaggctccaaggccacaaccatctcgttcttggccagagtgtccttaaaggagcgctccggggccgacagaggaacgccggccgcgttctcccggttgaatccggccctcgcctcgaagtccaacggatgaacctgcaaggacaaggggatgcgggccgaaatgaccttaaataagtagggcagaactgggccgaaatcctcggaatcctcctgcccgaccatgccctggggatcgcgctggatggcttgggtcaagggcaggccgcccccgtcaggcaacctgagcgtggacggggactgggggtgccccgagaaccacatctccgccaaggtgtccgccagcacgccgtccccgtccatcgcccgccctagcggcaggccgaacatgtcctgcaagcgggtatgcgagccccaggcgtaccgcttctgcacaggctctatagggtacacgtacgctcccttccgcttcaggcactcgcgccgccggtgctgccggacggccaggctccatagtatgtcagcgcttcgtcagaatccgcatctcctttgtcaaaggccgtaataaagtaatccctatgaaactcgcaccgattttcgacccggacgcccgtcggccttcgcccaagcccgtccaggtggatttgcggcgcatcttcttgggtggcacgacggcatggttgctgtctttaggggtatgcgccatcatgctctggtgcggggttgacgcgatgaaaccactgattgtctgcgcctcgggtgtgggcgtgggagtcttgctgctgatttgggagcacttcaaccgctgggactaccggcgcctggcccagtaaccccctttcctcactccgggtgcttggataccccctctcatggaccccggcagattcctttattcctttaaccttttagccctgattacattcctgaactgacacccgctggtccgccatccgtccgcccgaagccctccactgggaccgcacttgggtcagaggcggaagcaggagcgggcgccggagccaggggcagcgccagcgtgaaagtcgaaccctggcccggagcgctccagagcttgaccgaaccgtggtgggtcaaagccacatgcttgacgatggacagacccaggccgatgcccacctggctggcctcggtctgctcatcgccccggtagaagcgctcgaatacatgggcctggtcctccttgcggatgcccgcgccacggtcaatcacttggaccaggccgaaggagccgtccgccgaaggcttggcctccaggctgaccttggaaccagccggcgagtatcggatggcgttctccaccagcttggagacggctacgcgcacttgttcggggtcgccgagcaccggcaaaggcccgctcgaccggcagaccaagttcacgccggcttcctcggcttgcggccgcgccgcgtccaaagccttgctcgcctgctcgcccaggtccatgcgctcggtcttgctggctgaagtctcctcctgagcgcggattaagagaatgaggtcgccaagcgtgtgctccaagtagcgggagtaatccttgaccagcttggcttggctggagaccgccgccatgcgctcctccagccgctcgccctcccgccaggggcccttggccaaggccgtcaagctttcggcaagagcgcccagggagctgattggccgtgaaagctgccgagagacatgttcgatgaaggcctgtcgggtctgttcgaaacgcttggcctcactcacgtcatcaatcaagaccaggaccaggcccaggctgatcggaccgaccgctaccttgagccagttggggcgcgatacctcgctcagagccccatcatcgtggtccccaccctgatcagcgccttcctgcgtctcactcaaacccggcaaatccgcgaaagcctccggcgtggcggtggtcaacgagaagcgggagaccttgtcgctctgccaggcctggcggaccgcctcttctacccgctcgtcgacgatgcggtcctgactgacgatgcccaagcggtaggcgtccgggctggagcggaccacctgcccgtccctgcccaccagtacggcgagcgagcccaccagggagaggatggcctggctggaagcttccaggtcctcactggcctcctgcctcccctcgcgcgcggcggggttcgttagagcgctcaggcgatcggctaggaaacccatgcctcctcctcaccgggccagcgttggccctgggccgacctgggcatccgttgacgccaggccgtagactgttgtcatgcttcattatggcaggtctacaggagggcgaacggcatgcgagtgatttttaacgaggagatgcgtcaggtagctgacgacatggaccggatagcgggcgccgtcagtcaggccatcaagacctccggcaaggctttgctggagccgaacctggacgcggcccaggaggtgatcgacggcgaccaggccatcgaccagctggaaggctcgatcatcgaccagtgcgttcggctcctggccaagcagaacccggtggccaccgacctgcgcgtcatcgtctccacgctgcgcctggctgcgaccttcgagcggatgggcgacctctcccgccacatagccgaggccgtgcgccgagcctatcccgaccccccgctgccgcccgaggctcatgatctattcggccgcatgcaggatttcctgaaccagatgtcagaccggctggtggccatgctctccgatcgtgacaccaaggtggccgagcagatcatcatcgatgacgatcaactcgaccagctccaccagcagaccttcgatctggccctgtccgacgagtggaccggctccaaacagcagatgatcgacctggtcttgctggcccgcttcatggagcgcatcggcgaccacggcgtgtccgccgcccgccgcgtcgtctacatcgtctccggtttcgaccccaccaaggaccccaaggacctggaagacatcgactgacagccggcacggaccaatacgagcaggcccccgcatccaagatgaacgcgggggcctgctcctgttaaggcttaccgcaagcgcttgcggcctaagctcacttctggccctgagcggcgacggctgcggcgccagcggcggcggcctccgggtccaggtactcgccgcgcggcttaatcggcttgaagttctcgtccagctcgtagagcagggggatggcggtggggatgttcaccttggcgatctcctcctcgctcaggccgtccagcatcttgacgatggcgcgaagggagttgccatgggcggcgatcatcactgtcttgccggtcttgagctcagggacgatgtcggactcccagtagggggtcacgcgcttgaccacattggacagggcctcgcagcgcggcacgggcactcccgcgtactgggggtcgtgggcctgcgagtacttgtcgtccgggtcgatctcgggcggcggggtggcgtaagagcggcgccagagcatgaacttctcgtcgccgtactcctcgcggatctcagtcttgttcttgccctgcagggcaccgtagtggcgctcgttgagcctccagtcacgcttgaccggaatccagagacggtcggccacatccagggagatgttcgccgtgttgatggcgcgacgcaggagggaggtgaagacgatgtcaggcaggacgcccttatccttcaggagctggccacccttgcgggcctcctgctcgccctgctcggtcagcgggacgtccacccagccggtgaactgattggtgttgttccatgcgctctggccatgccggagcaatactagtttgtatgtcatgcttcacagtttaatcgccctgccagaccatgaagaccagctttatgcgcgcgctaacagtccggtttcagaccagttgcaggagcagtccgagcgtccagcacaaggcggaaatcagcgtgccctgaccagacaggacaaaggccttaggctggttcctgcgggcgaagaacgcgcaaacgaaaccgaagcagacggcaatcggaatcacgaccagccaggcgggcagctccacggatccgaacctccagaccgcgccggcgaactccacgatagccaatgccaagctgagcaggtagaccgcgtaaatagagactctggcagccttatctcccacaatcgtggcgtaggtatgcttaccggagcgcttgtcggactcgatatcgcgatagttattgaacatcagcagccccaccgcgttcaaacccgcagcggacgcgcccagccagccggcggtgctgagggcgccgaccatgaagtactcggtgcccaaggtggccaccaggccgaagaagatgaacacgaagacctcgcccagaccgtagtacccgtagggatgcttgccgccggtgtagaaccagcctgcagcgaagcagaccaggccggccagcagcatccaccagtggccggtgattacaacggccgctaaaccaagcaaagcagtgatgaccaccgcaatcatcatggcggtgaagaccttgcgtggggccacaccggaggccaccagccgacggggcttgccggaaacctcctcatcggcgctgcggttggcatcagtgccgcgaatcccgtccgaataatcgttggcgaaattggcggcaatctgcatgaacaaggccaggaaaaccaaaaggatgaagaccgtcaacagctggccaccgctcactgcgctgattcgtgccgcccgggcagtttcagccggatcggcaggcacggggcaagtgcccgcgcaagccgccgcggaccgggagcgcaggagcagggcggccgccgcgcccacgcagaccggagccaccgaagcgggcaaggtcttgggacgtagcccgttaatccacaatttgacgttcataccatctcctctgccaggcgaattatgcatgggacgaacccggccaggcttcgcctgaatcggcggggctcagccccgaatccggttgatctcagaccagcggcttgaccaaggggaaggtgatggtctcacggatggtggcgccggtcaaggcaatcagcagacggtcaatgcccatgcccatgccaccggtcgggggcatgcccacgcccagggcctccaggaagtcctcgtcgatgtcggtggcttcttcgtctccagcggccgcgtccttggcctgctggatgaagcgctcgcgctgcacgaccggatcgttgagctcggagtagccagtggccagctcgaaacctcgcacgtacaggtcccacttctccaccatgccgggcttggagcgatgggccttgaccaggggcgaggtctctacggggaagtcgcgcacgaatgtgggctcgtagagcttgtcctcgtagaagtgctcccagagatgttcgaccagcttgccgtggttctcgacctcgtcgcgctcaacgccaagcttgtcagcgatggcgcccaagtgctccacggaggtctcaggagtgatctcctcgcccaaggcctcggacagggagccgtacatggtcatcgtcttccattcgccgccgaagtcgtactcctcgccacccagcagggtgaccttggtggagccgaaggcgtcgagggcggcctgctgcaccagctgcttggtcaggtcaccaatcgtatcgtaggtgccataggcctggtaggcctccagcatggtgaactcgggagcgtgcgtgccatccacgccctcgttgcggaagtcgcggttgatctcgaagacccgctcgatgccgcccaccaagcagcgtttcaaaaagagctcgggggcgatgcgcagaaagaggtcgatgtcgaaggcgttcatgtgcgtagtgaacgggcgggccgccgctcccccgtgcacggtctgcagcatgggcgtctcgacttccaggaagtcctgggattcgaaggtgcggcgcagggaggagaccaccttggagcgcctgcggaccatatcacgtgtggcttcgtcggcgatcatggccaggtagggcttgcgggtgcgctgctcgtccgacaattccttgtggagcgcaggcaggggttgtaaggccttggccgcgatggcccactccgtggcgaagaccgagagctcgccggtcttggaagcgatcacccgaccacggacatagagctgatcacctaaatccaccagttgcttgaaggacttgagcgagtccgcgccaacctccttcttggagatcatgccctggatggtggtgccgtcgccggcggacagctgcacgaagcataggccgccgccattgcgcaggaagagcacacggccggcgatgccgaccacatcctcagtctcctgccccggctccaacttgccctcatactcggctcgcacatgctcgatgcggtcagtcacatccaagtgaaccgggtatggagcgatgccctgcttaagcatgagcgcccgtttagccacgcgcatctgcacctgctcggggtgggcccgggggccgaactcgcggttggacggatccaccgcttcttccagctcaagaccctggtccaccttggcggcgatggccttgtcctggtccagcagcatctgcgcccgctccacggtggagatgccggttccattttccgacgcttcttcgctctgggcaccatgttctataaagtcagtcataagtccccagtgtacgcaaacgccagtacttcactggcctcccagcggtggccgcgcctcgccgcgccagccgccccgccgcgcgagtcttggcatttgagcaccggtgcgtgtactatatagaacgttgtcgcggggtatagcgcagcttggtagcgcgcttcgttcgggacgaagaggccgggggttcaaatccccctaccccgacaatcattccggccctctaagggccggaattccaacctttctagaatctcacgtagtcagcgaaacacgttctgagcgcattttggcgcaccttgcagcagcaactcgttcatcgactcctccaccacgtccaagtcctcgtcgaacgcatccgcctacacatccaacgtcatcgccgtgcagggcatggcgccagccccagaacagctcctacaccgattcggttctcgcttgcgatccctgaacatgagtgacccttaacgagggccgccctccccgacctccccagccgcatatcattgccccgcttgagcggataggagctcaatagcgggggtgcgtaaggcccggaccgaggcgagcaagaaaatgagggaccccagggcagagacggcaagggtcatccggaaccagagggaccaggagatggagaggaccgcggtgcccaggatggcccgaatgtcgaagtaggcgcaggccgtggcggggatgacaatcaggaaggcggcgagcatggcggtcagcatgatgatggagccttccagcagggccatgaaccgcagctgccggggttcggcaccggagatgtcgagcagggcctggtcaaagccgcgctcccgggagaccatgcagaaaccagccagggcaccgcccagggccacgacggcctctgggccgatggcgccgataacgccaggcataccggtgctggtggtgccgggaggtgtggagtatccggccaccctcaagagcgaggccgagaaaatctgtattggagtgcccatccccataatcaaaccgacgcagaccatgagcggggccagcaccgagctggaacgctcgatgcgggagacggtctgccgccgagccagggcccagggcgcggcagggaaaggcacaagtgaggtccagagcctgaccaggccgccgtagaggaggggggccaggaaggcgaaggcgatcatgagcagcaagagcccgcctatggccgagtagtacatcgtgcccatatcctcgtagaaggttttcatggcagccttcccgccagagaggtcgacccgatgcacgctcctggcaggcaggatgaacacatagaccgcgcccaagaatgaggccagtgcaaggaggatgcggataccgccgggtcgcttggaagtgacgggttgggagcggtaagcctcgaccggatccacacgggatgccgagcgaacggtcagggtggtgccgatgagcgccgtggccaagccaatcgctacgcccaggaaccaggatcgagcatcagcatggtaggtgtaggagtccgccatcgtgctgtaagtcctgaggaggtatttgaaaaacgcgggagccaccagcggagccacagcggccgacaggattgaggcggtcaaacccaggaccaggaccagcagctccatcagggcggtcagctggattggggtggcgccctgcatggccagcagggccagctgtttgcgctgctgattgattgcggccgagaccacccacaaggtgatgaagactccgacgatgatggtgatgggcagttggtcggtgtccatcatgcgcgtcatctgataggcatcctcggccaggccgccctgggcattggcctgggtgtaccgggaggagccagcgatcagcgtcatgccgctcatcacggtctgcaccacgctcaagtagaggaagactccaatccacacgcccggcgcagcacgcaagcttgtcagtatcgctttcaccttgcacctccggttatgcgcccatccaccagggtgaccacccgatcgcagctggaggccacctcctcggagtgggtaaccacgacgacagccctggccgggtccgccgccacccggtgcagctcatcaatcaccacccgaccggtggcctgatccaaagcgcccgtaggctcgtcagcaaagaccacatcaggcttggagaccaacacccgagccagggccactcgctgctgctcgccgcccgagagggagcctatgtccgagcgccgccggtcggccatgccaaaacgctccagcatggcggcgatctcgcccttgggagcccgccgccctcgcagcaggaagggcaaggctatgttctcctccacattcaacgtgggcaccagattgtaggactggaaaacgaaacccaggtgggcgcggcggaatcgcgccatcttcgccctccccatccggtcgatccgctcccccagcaccgtcacctggccgcccgatatggattccaagccagccagggagtaaaggagcgtggacttgcctgagcccgagggcccgacgatgcctgtcatccgcccccagtcggcctgaaaatccacgccgtgaaggatgcggatggtctcatccttgcgcaagctcacatccttgatcaatccccgggcttcgataggtgggaaaccgcgcatttgagctacctgtgattgcatgtccgaaccctcttcccgcacccgttgcgcatcctctgggcacgactgaaaacgcatgcccaataactccatggaaacatccacaagggtgttcccagggcgttttcagggtgcattcagggtgtattcgaggaaaaatcaggggttcacctgaccctgcgaccgcagcgccttgatgatacctgatccgcaagagcaggcggaggcgcgcttgatgcgcataacctcatccgcactgattcgtcgccaccgaccacaccagcacggcccgggaacaactcattcccggtgaagccatccgctcacttggcccccgccccatcaagggaaccgagctccttgagccgggagcgcaccttgtggagcttggcataaacctgattacgctgagtcgggtctttggcgcgggcgtgatccttggacaatttgacctcctcggccaccagctcagtaatcaaatcacgccgggctatccgggcgtccaaatcagcgccttccggctcgcccaaaatcacttgcgcgctcagcccttcccacgccttgtccatattcgccccagacaaggtcagcttgacctgaccggatggcttccatggactcgcaaagacgcggaaagccggttcatgacctggcttagtgggcatgggacggcgcaccgccaaagcgcattcatcgccctgaccgccctcttcccggctttggcgaacgcaggcgaaaacgatacgggaagagcgcataccagctatgcgatccacaatctccaggggcgtctgctcgcaggtcaagtccaggcccatcaccaatatctcctgaacatgctcccctggcgccaaacccgcgtcggcgggccgcagcagggccagcatcgtcacggagcgcaggtcgttggtgaaccgctgcttaagcctggcggaggtcggtcgcttggcgtagaacatctgcttgggcagctcccccttcccctccggcacggcagtcgcgggcggcagcccgagtgtgagcgcggacacggaaccacaggcttgtgctgtcatattcggcctttcttgaaaaccggctggtttggccccatcccactgacccttcccttcaggaatgtagtcctatcctactgcctgcaggcttggatcgccgtccgcctggcgccgtcggattgactttgacgcttcccgattccggcatgattcgctccgattcttcgcatgcgagcggtataacccaccccccgaatccgattgtcggacagaggctgcatacagagaaaagggaaaatgtgagcgctaacgaaacgtttggtttcatgtcatccctccggtacgatgggaattgcagttcgcccggaacggcgtagttgcgaccgttgaagggcggtaggcgcggactcagccaccaacagcgggccggtccgctaagcgcggcgcaaagagcggcgcgcggacgtgaaacgcaaaggagcagacatgcctcagaagattaaggcttcgatcgcctacggcatcggcaagggattcgcccagccggaggagatcatcatcgacgaccccaagggcgccgaggtcctggtagacgtgcaagcttccggcctgtgccattccgacctgcacctggtggaggacgacgaccagttcttccccttccccgcagtcatcggccatgaggtggcgggcatcgtcgaggccgtcggccccgaggtctccggcatcaaggtgggcgaccacgtggtggcttccctggagcaggtgtgcgggcactgcgccaactgcctgaaggggcagccccagtcttgcatgcagcagcaggagtgcgtacgcgccgagggtgacaccccccgcctgtccttccccgacggccggcccatcacccaggccttcggcaccggcggtttcgccgagaaggcactgatccacgagaatcagctggccgttgtcaacaatgaggtgccgtgggaccaggccgcctgcatcggctgcgccacaatcaccggcgccggcgccgtgatcaacaccgcccacgtacgccccggcgacacggtcgccgtcatcggcaccggcggcatcggcctgaacatcatctccggcgcccgcatctgcggagctaagaagatcatcgccatcgacctgctggacaacaagctggagttcgccaagaagttcggcgccaccgacgtgatcaactccaagaacgaggatccggtcgccaaggtgcgcgagctcaccgacggcggcgtggaccaggccttcgaggccatcggcctgaggtcgaccatgaagcaggcttgggacatgctgggcgtgggcggcaccgcctacccaatcggcctgaccaagccggacgcgaccgtcgagctggagatcaacccggccgacctgctggtgcaccagcgcggcttcaagggcgtgtggatgggttcgaccaacatcaagcacgacatccccatgtacgcggacctggctgttgatggccgcctgaacatgaaggacatcgtgacccagcacatcaacctgagccagatcgacgaggcctacaagcagctcgtcgccggcgaggtcatccgctcggtcatcactgagttctaagcggctcatgtttaaacggcattaaaggcccacctgactgaaacagtgcaatactactgtttcagtcaggtgggcgctcatgtacagcatgcacagcaatcgccaaaggagtgcgatccaagcggcccaactcgatacaatcgccagccctccgaaattgccggccgcaagccctccatcccctgctctcggtatccctgctgctctcggtgtctgcggatacgcctgtaggcggccgcttcgacgccctgctcaccaactggcacccgaatgacgatatcggtctgattaaatggccgttcggttggaaccttaaccaggggttttgcttgattaactaacgtctgcgaaactcgcggatgaatgttagactattaagaggagcaggggttttaccatgcctggcgttttgggaaccgtacggggttggcataacccctagttgttgttttgatttttcggtccaagcgcttgaaggcacactaagggcccaattggaggggttatgcgctgctaccgttctttgagtgccatcgtggctctcatatctctgattgtcctggggggggggggcagtttagcacgacccgccccagcgcatgcagactccgtatccgacgcgcaaggtttctccctctcgccaatcaaaggcccagcggaaggtggcaacgacgtcgctattacaccgccgttctcgacgtcagttaagtttagagacatttatgtcggcagcatccataccgtagcggtggactccaatggagacgtttgggcatggggcgctggaaatctaggacaattgggcaacggttcaacgaacgcttccaataacctgcctgttcgcgttagagttcccaatggagtgaagttcacatccattagcgtcggactgtggcataacttggcgatcggcacagatggacacacatatgcttggggttacaacgtttatggacaattaggaaatgattctttcgacaacgctttggaaccccaaaaagtgaaaactcccggcaacgtaaaatttgttagcgtaagcgcaggtggaacatcctctttagccatcggggacgatgggaatgcctatgcgtggggttttaataatagcgggcagctcggggatggcacgattacaaaccgcaatacacctacccctgtcaatacttctgcgaaattcgcttctatcagcatgggcggtcgacacgctttagcaatcggaaccgacggcaaaatgtacgcctggggcgataactcctatggagaactaggaaacgggactcccgggactagccaacgcaccccaatcgctatcgaaaacgcgccgaagtttaataccgttaaagctggcggcaccgacagatggggcggtagttcatacgatttttcccttggcataggtaaagacggcacaacttacgcatgggggtataacggcgcaggccaattgggcataggttccacagacgataagtcagtacctacgccggtgaaccctcctttaaagttctcagcaatgagtcctggcgcgtatcatgctctagctctcaccaatgatggcgatgcttacgggtggggccaaaatagtagtatcataccaacgtttgaaagtgctggaaacatcggagatgggtcacgtgtggatcggcatagcccagttgccgttcagaagccagataatgtttcgccggatttcaagttcgttagcataagcgctggttggtcttcgtctgcggcaataggaaacgatgggaacgcttacgcatgggggacaaacacatctgggcaattgggagatgggacaaacaccctgcgacttcaacctgttcgcgtagccaaacctaaaatcgcagtcactagcgtcagcttcgatggcattaacgcggggacgattacccacgatccggctacggatttattccatgtcaatgcgcctcagcacacgtcccccgggaagatacaggtgcgggtggaatggacagtgaacggacaggctcagacggcggctgtgctggattatgagtatatggcttcgtattcggtgagctttgacatggctggggcaccggtcacgccgccagcgcagcagcatgtgatggatgggcagaaagcttcttggcccacggatgatctcaagtgggacggacactggtttgggggctgggaactcaatgggaatgcctacgactttacccagccggtaaccaacaacattacgctcaaggcccggtgggattcgtatacgttcactatttcaccagtcaaggggcccagcacaggcggcgcacacgttaccgtgacgcccccggctttcgacgcaacgctgacgcaggtgagcgcaggctggtaccactcgctgggcttggggcgcgacgggaaggtctacgcctgggggcgcaacgatgccggacagctgggcgacggcacgaccagcaaccgtacttcgccggtcgcagtgcatatgccaggcggcatgaagttcacacaggtcgtggccgggccgaacgactccttcgccctggccgccaatggcttcctctacgcctggggttggaacagcaaagggcagctgggcaacgggaatacggtggaccagtccacgcccgtgatagtaccggtgcccgaagggtctaccaagtacacgaaaatcattcccggccgcgagcacaccttcgctgtgaccgacactggggtcctttatgcttggggcggtaacgaccaagggcagctgggcataggcacggtttacaactcgccgacacccgtcaaggtcgagttgccgtctggtgtcacaggttttacgcagattagcgcaggaaacgcgcacacggtggccatcagctctacaggacaggcctacagctggggttcgaacggttacggccagctgggttcgacagccgttacagtcggcgggcggtccttgttgccggtcgcggtcactgcgcccagcggggtgtcaggcttcaaacaggtggtggccagcaacgactggagcctgggcatcagctcaagcggccgcatctacacctggggctgcaacagcgccaaccagctgggtaacggcaacggcgccaaccagagcgcgccagtagcgcctacgctgccaaccggcctcagcttcgaccaagtgaacgtagtaggggacagcgcggtggcgctcgccaactccggcgcggcctgggcctggggcgacaaccaatacggacagctcggcaacggcaatcaaagcaaccagtccagaccggtgtcaatcaacccacccagcggtgttacctatgccaaagtgacggtcggcaagcagcacagcctggccatagacaccactggcaaggcctgggcctggggcgacaaccagtacgggcagctcggcaacagcgctggcgggtcggccgggaacctaagcctgaccgcagtggtgatgacacagccaaagctggtcatcaccaaagtgcagtttgacggcactgccggcacagcgctgaccgccaactctaacggcacctggggcgtcgatacgcccgcccacgttgaaggtcccgtgaccgtgaccatctcctggagcctggcgagtgcgccgcaaaccgactacaaaatcaactcctacacctatttcactgcgttcacgctacccaaggccggaacggcgcccctgcagctactgaccgggaaaacgctgcttctggtgagcgcgctggcggctggctgctgcggagggtatcagaatgctcgacggaagcaatcgcgccgcaaaccggagcacagcagcaaaaacggggtcgctcgcatcggctgagcgaaggctcgtgcggagacgacgacacccgctgatgcctaccgattccacccgggccagcacattcgaccaccttgctctcggcgggcttgcgcttcgagcggcttgaaggtctagcctgaggccagcgcgcacaggtagcgcggaaaggtaggctctgatgagcattgagaacaaggtagtcctgattaccggcgcatcctcgggaattggcgaggcgagcgcccgcctgctggcctcacggggggcaaaggtagtgctcggggctcggcgggatgacaggctccggcagatagcggaaggcatcgaggaagacggcggccaggctgcctggcggaagttggatgtgaccgacccacagcagaataaggatttcgtggccttcgccaaggagcgttacggccaggtggacgtgatgttcctgaacgccggtctcatgccctcctcccctctctctgccctcaagacggacgagtgggaccggatggtggacgtgaacctcaagggggtgctccacggcatcgccgcggccctgccggagttcacggcgcaaaaatcggggcagttcatcactacttcatctgtggcagggctgaaggcgtaccccaacggcgctgtctacggagccaccaagtgggctgtccgcgaactgatggaagtcctgcgcatggaatcggccatggagggcacccacatccgcacggccaccatctacccggcggccatccagaccgagctgctcaacaccattaccgataagggcgccaaagaagccatgaaccagacctatgactcctaccagatcacgcccgaccgcgtggcctccgtagtggccttcgccatcgatcagcccgaggacaccaacgtctcggaattcacgattggccccaccatccagccctggtgaaggcggacggcgaaagtaaaccggaacgttaaccacgagcccgggagccggcgcgataccgtcaggttgcatcgcaccggctcgatttttcataccccgacaggcgctggtggaacagcggtcattggcgccgttgcgtttcccgccccaacatcagcaataagccatgccctccctgcaggggtgacctacttaacccagagctcggaatcgaggggccactcgttggggacgcaaccgtgcaggcccatagactgctccagcatgagaggggcgggctggccagggccggcgcaggcctgctcgttgtcaatgtggcccaggcgatggcctacctcgtgattgatgaccatgatccggtagcgggccatgtcaccgcccgagcccagccagtagtcggtaccgccgttccaacggtccttgttgatgatgacctgattgcccacccggcagctgtacagcgaagagcagcccaaagcgaacgtgcgcatgtattgggcctcagacaggatcaaggtcatgtcgcaggaaccctgggagccttgcacgaaggtagtcccagccctcggccagcctcgaggatcgttcaggctaaggaaaatggtcctctcaaaagcggccgtatcgccgacctgccctttaccggccacgcagtaagtaagccgacgcgggggtttgccggacgccgcggccgttgcttccgccacggaaagtaccgacgcccgattcggctcacctagtggggcggcgggactggcggtaggcttgccgccaggcttgggctgtacacgcacgggtcgggcgctgacactggccgagggacttggacccggatgggagaaccggcgggctgagacgcccagggccacaataatgcagaggacgagcagcgcgcagagggtggtcaagacccagcggcgtattcggaaaatgcgctcccgctgagagtcggaaaccttgacggcactacctgggcgcaggacttccagaagcgaccggcaaccagtgaggaaggtgcggagccagttcgccgggcggttaccgtgccccgctccacctcggcgattcgcccctcctgatcgtgctcccatcccatgcccctctccaactcgactgcttcaatgcgtccgagcgcacaacatcattatcttgtcgagtcctgacacatcacagccccgaaccaccctcgcaaccgcccatcagcccgccaagcgcccatgccgcgacgaacaggccccagcgtacactacggaagcagccgccgagcgcgatacggcgggagccgcacgcacaccaaccacatggatacggaagagcactcgtatgaagaaaagcctgatagcgctggccgccggagccttcgccctgggagccgccgaattcgtgatgatgggcatcctgccgcagaccgcgcaagccatgaatgtctcaatcccccaagcagggcggttcatctcagcttatgcgattggggtgtgcgtgggcgcgctgatgctggtcttcggccgcaaaaccccgcccaagcgcctaatcatcctctttctggcactgattgtgattggcaacggctgctcggccttgtccacgagcgcgatcgcactgaccatgtctcgattcatcgccgggttgccccacggcgccttcttcgggaccgccgcctacatcgccaagtcgaccgcccgccccgacaagcaagcccaggccgtagcggtcaccatcaccggccagaccctggcgaacatgttgggcgtgcccgggggcaccctgctggccgaatacctgtcttggcgcgcggcgttcgctttcctggcggtctggggcgcagcgaccatcctgctgtccttgcgttggctccccaacctgccccctgtgccggattcgggcctacgcggccagttccacttcctgaagcgccggggtccttgggtcatcctgctagccgtgttcactggcaatgccggcctgttctgctggtggagctacgtctccccctggctgacccaggctggtggatggtcgtccagcgccctctccgctctgatggtactggcaggcttcggcatggtagtcggcggcctggcgggaggcgccctctgcgaccgctggcggcacgccggtaccgccgccctggggcagaccatctccttcctgggcctggtcgccatcttcctgattccagggtccaaattgggctcagcgatccttaccttctgggtggcgttcggcctcttcttcgtctccaccccccagcaaatcctcatggtcgatgccggtcagggcggtggcgagcttattggcggcgccaccatccaggtggccttcaacctgggcaacgctgttggctcgatgctgggaggcgcagcgctctccgccaccggcatggactaccgcttcccggccctgaccggtgcgcccctggccctggccgcagccctcttactgctcttctactcccaccgcctggagaccaagaccgatgcggtcgataggctgcaggtggtcaaggtttgagcgtagtcttggcgcatggaagacttggacgatgacggcaagaacagtgggcctttgaagggttcgcctacatatatgcgccagaacgggtcctttgacagcgggcggttcatacagggcttggatgcgattttcgactcggataggtccaatgacgacgcggaatgctacctcctgcaggcacttgcggacgccgagcaagctgacgaccaggccggacagctcacagtgctcaacgaggtgatcggctactaccggtcacggggacggcacgaggacggcctacccatgattgagcgatcgctcgatttagctcgccacatgggcctggaaggcaccgaagcctggaccactacgctaatcaacgcagccaccggaatgcgcgccgccagccgctatgagcgagccgaaaagctctacaagcaggccctggcttcagccgagaggacgctgaaaccggacgaccggcgcctggccgcactgcacaacaacctctccatgctctacagtgacacagggcgcggcgaccagggcgtgcaagaacttcagaaagccctatccatcgtgaccgcctcctccaccgacccggatgcggacctggacgtggcgtccacccacaccaacctggccctggccctgctggacctgccagccgacgacgaccagggcgagcgcgaacaggtcctcgctcaagcgatggcacacgcctccaaggcgctcgacatctaccgggtcggccacttggaagccaacccgcacttcgcctcagcgctggcgggctatgggcaggcctgcttcgcgagcggccaatacgggcgggctgcgggcgcttaccagcaggccctgggcatcatcgcccgcgactatggcgaggccagcgactcctaccgcatcacccaggagaacttgagtcaagccctccaagccgccaagcaggctgggcaggaaatccaagggccagacaaggaagccggggccgacggcgagggttcagaccccggtacgggcgcggacgctagcacgaacaagcacagcgagcgcccgcccatgagcggcttgaaactggcgcgcgcttactgggagcagtgcggcaagccgatgatcgaagccaaatacccccagtatgcaggccgaatcgctgctggattagtggggcatggctccgaatgctacggcttcgacgatgcgatttctcgggatcacgactttggccccggcttttgcctgtggttgaccgccgaggactacgcggcgatcggtgaacagctccaagccgattacgaagccctcccccaggagttcatgggctacggcccgcgcgagcgcagcgtgcgcgcccggggcgaggccaagcgggtgggcgtcttcgagataggcgacttcttcgagtcaatcactggttaccggcaggccccggacgaagataagccgcacgaatggcttttgctggacgaagccacgctagcggccgccaccaacggcgagatcttctctgaccctttgggcgccttactgagcacccggcaaggttttcaatccatgccggacgacgtgcgattcgccctgatctcgcgccgtttggggatgatcagccaggccggccaatacaacctgcaacgcagtctggagcgcggggatggcgcagccgcttggctggcggtcgacgagttcgcgaaagccgtggcttctctggtctttctgatcaacaatccactgaccgtaggctacctgccctactacaaatggacgttcgccgcactccgccagctgagtggccgggtggcgacccgtctgagcccggtggcgggggaactggaatccatcctgcgcttgtcctcggccgcctgcttcggcggcgcgggcttcggcgaagggggtaagggggcggccccagccgccgagcgcctgaccgggcaggttgaaaccgtctgccagcaaattctccaagagctccgagccgaggggctgaccaactcgagcgagggcttcttggagtggcaacggccttatatcgaggcgcatatcagcagccaagaccccgtcctccacagcatttgaatcatgacgggggcaagtatcagccgaaatcgaggggattagatgagcgaacgagcatacagcgagctgagcgacgacgacctgcgcgagcgaatcgtcaagcacgagtgggaccaattccagcaggtggataatgagggcggccgggccaactgccagggcaactggcccacgttccaccagatgcgcctcagtcagttctcggtctggccgcgcgagctgctggagagctacgcggacgaccttgaccgggcggacgcggaggcccgtaacctgctgaccgaaaagtacggccggatgatggagtccaccgcgcccgaggactaccggcgcgacatcgccccctacctgcccaagttgggcttggaacgtcaagagcgccaggagcgagtcatccgtcagcaagtggcctgggccaaggacttccgcgaccgctaccccacgctgggccaggagatgcggaggctgcgaacagccgatgacaccgcccaggacacgtcattcgagacctatctgcgcggcgaactgtccacctactcgctgaagaccttgggattgtacgagaagatggtcctattcacagccagccagcgacgcaatctgaccgaagagaccttgttggcgacggtcaagatggccggctacccggacctggaccaggctgaggccgcgcaacgcaaggccacgcccaccgcctgacgcgggagaggaccgcggaaaaaggcagggccaccccttgtgccacagttagttcgtgcgaattctcaaacggctggtgacaccgctgatcgccttcgtcctactgctgggccttctggctggggccggagccctgatgacccctgcatggcaggtggaaccctatcaggggcgcgtgcgcccacagacgtcggacacctcaatcgcatcctcgatgggccctacagcacccgaaggaagctatcggacacgcgagagcgacatcaaggtgcagctcgcgccggcggtcaccattcacgcgattgtgcgcgaaccggtgggcgccccggccggtcgcccagcctgcctgttcatccacggagccggcaccggttcggccggtaaggtatacggggacctggcctcagccatggcttcagccggtatcaccaccctggtgccggacaagcgactggacacttacaccgacttccaccgcaactatgcggccatggctgatgactacgggcgctccctgaaagtcctgcgctcctggcccggcgtcgaccccgccaaaaccgggctctacgccgagtccgagggcacctgggtctcctcgatcatgaccgcgcgcgacccctcgctgaccttcacgatcctgacttctcccccggtctacccgggccgcgaccagatggccatggccgtcagctcctacctggacatcatcggcgccccggcgggggtccgggcggacatcccgaagctactaggcatgaatttcgcccctctggggctgcaatacgcggatttcgacgccctgccatactggagcaagctgacccagcccaccctcatcaacttcggcgtgaacgacgcctccatgccggtcgagcagggcgccaggcagattctcgaccaagcgcgccaggccggcaatcgcaacgtgacggtccgctactacccagccaaccaccagatgcgcgtaggcagccgcctggccaaggccagtctgcccctggaatcccattacacgcgcaatttggaggattggatcaatgcggtggcccagggcaccaaggccgatggctggaccaccccgcaattagcaggcgcccaaccgcaacagacttacgccgcccctcaacacaccagccccggcctggtcacgtcaatcggtgcgttggccgtcctcctggccaccggccccgtcctgctgctggccgcgctagtgggttcattgaccctggccctagcgagcgcgatccgccgccgtaaatcgcagcagacctcgcctccccgtttcggccgaggcgtggccgccctcctgtgggctcaggcgatcgcatccctcctgctgctggccgccgttctgggctatatcgcgatcatcggcgcgcacgcgctgagattggaagcgcttacgacgacgcaggtaaggttgtggaccggattgaaagcgctagccctcgtcacgaccgccttgtccgcgctcctgccagcccgggccatcaaggcctggatgacccggcgcgcgcccgcaggcagccgggccgaagcgattcaagccggcgctttccacgcccggcctcaagcgacaagcgccgcgaagggccgacccgccctagcccggggttggggacactggatagtcctaaccctggcctggttgggcgcattggcctgcctgctggtcctggctttctggggcgcatacaccttctgagggctgcggccggaggctccccgctaccacgggccatttctgcccgaatcggccccagccctagtcttcgcccggagagccaggggccgcgccttggccggaccgcctccctttagtccaagagaccagcccccaaaccaggcctgccaggaggaagaaaccgcccaacaccgcgcacatcatcatcaagaccgtttccgcagtgaaatgcagccccaccatgccgtaccaggagaagcaagcccccgaaaccaggcagaagacacccacgaccgccaacagtaagccgaagatgatggtcgccgcattcggtccagtgggcatgacccattggaccggctgctggggctgcgcataagcgtacggaggcgtggacacgtaggtcggcggctcccctgtcggcccttgcctccaggatgcctggtccgagcccccgcgaggactgtcgggcccgacacccccggcgctgaagccctgagatgccgctgactgggcggaaccgcctgcgcctggaccagcgccctcagtatctgagccggttccgttccgtctgggcgaggcggccttaaagtcagtgccgtcagaggcgatggcgccatcggccggcccgtcttcgccgcccgactcgcctccgccgctcatcgcgccgccgttcgttcgggtcgtgcgcgtctcctggttcaattcctcgctcaagcccggcacttcgaccggactttgggtagtctgagcgcttgcctgggccgcttccacctgttcggtcgcttcctgatcccctggcccgccaatcacgccctcgacctcggtttcatcactcgtcatcttcatcatcctcactgttttggtcgcggtggacgcgatcatgcataaagggctggtcgttaccgtcctgaggcaaggtcgcggtccctgaatgacggaaagacagctcgcagtccgaggaatgaacgaacttcacatcaagctcgggttggctcaccgccccgtgaccctcggattcctcaatcccgtcgccggcgtggacgtcccagcccaggcccagctgcgcatgatggtccaaccatgagctcaggtccaagggcgcgccgccagcggccggcagatcgtttaaaaccctccccttgaccagcgcgtaggaacagcctcggggcagtttcaccagcaggttcgcggcggaggccgctatacgcacctggccggccgggcagcccgaatcctgcttggagccgtcgttcatccgcacccggtgcttgccgttgttcgcctggtaatcgctcaggtccaaggtgacgctagccggggacgcctggtctccggtcaggaagatgccacgttcatagcggcgcatctgctcgggcttggaatccaacttcagatgctcattggcgggcagactgaccgtctcgtatccagccagctcctggcgcaagtcgttgcggttgacctccaagccgatggaaccggccgccactatcacggccatcagcaggacgatgaccgccacgggaatcagcccaccggagcgatggcccatcgcacccaggaccatcagcagaacacccaaggccagggagaggccgcccacccagataagccctagccgcagtgtggacaaggacgccacttcgcccgaacggcagtccaagccccacaccaccaagccactcagaaatacgacccccaggcagaccagcaccagggcgggcccagctggcttccgtcgggctttacgcacccgggatccctggaacccaggcgcgggggcggcagaggacgcatagcccggaggagacggaccttgctcgtagccgtaaggcccatatgcaggagtggggcgcggggccggcgcagggccagggaccgggccagggccggccggcgcgggacccggctcccgccagccggaatcatcgaaagggacagggccccctgactgccagcccgggccatacccccagccgtatcgcttggcttgttcgccgctccaggccagcaaggcccacaggaccaggaccgccaccagcgcgggaacgattatggcatgagaaccgatcgatagaatccagcagaggatgattcccaccatcgacccgtgccatatgccggcgaaaaggtcctcagccacgatgacgccgtgcttgtcgggcaggatgaaccaggcgaagccatagaaggccgctccggccccgaagcacaggaggaagaccaccatgatcacgcgcaccagggccggcgaccaacctaggcgttcggccaggccgccgcatactccaccgacccagcggttgtcggaccggcgcaagtagctgccgcgcacccaggagaagaagcggctggtgacgccggctcccaccggtttgaacgggccaggcccgggtcgcggcccgggctgttggtagttagggttcgagccggccgccggaccctgtccccagccgggcccgccttgcgcgccaggtcccgcttgccactggccatacccatgacccgaatccgcgccaggctcctgaccgtagccgcctccggcgccggaaccaccctggtaacccttgcccgcttccgggcctgtctgctggttgaaatcgctcatatccccattacagcaggacgagacccgccaacctatccgggaacaccctgattccaccctgattttccagcgaaacccgcttccagggggtcgcaggggcaataatggcagtatgttctcccatcgccggcgccgcgaggctcagcccagacagcagccatacggctacagctgcggtcagccgccctacaccccgcccgaacccaaccccggtccggttcccggccaaacgcccgacttcacccgctacaggcctggcctggcctacacgccacctgactcggcacccaccgcacccccaccgctcatgccggcccgcctccccctgatgcgcccccgacacggccgaatcctatgcggggtgtgccggggcatcagccttcacctgggcgtcagcgtgacttgggtgcgcctggccatgctggccctcactttcgcgttcggcatcgggatggcggcctacatcctcctgtggattttcgtccccgtcggcgacccttacgtagccgcccaggccgctgccagcaccggtgagcactcgcctttatcccgaggcaacgcaccatccgccagcgaacctgacgaaaaggagggcacggaggcccgggaaggcctgctcgatgtgctgcgcggcgcgtctaaaccggtattgctgatcggccttggcgccctcttactgactctggcgctctccttcctgtggcggggactgcctggccacttagtgctgccagccctcttgctgggggcgggaatcgcggtcgcctggctgcgattcgatggcgcccgccaccgcgtttccacactggctctgtccgcctgcttgattctggccgccctggcctcctacgtgttccctgtcttccccctgcgcgaagcctggcagatgatgattctgaccctagccgtcctggcctcggtggcggtggttctgaccccctgggcccaagccctcctccagcggatcagctcggagcgcgccggcaaggagcgcgaagaggagcgcgcggacatggccgcccacctgcacgacggcgtcttgcagaccctggccctgatccagctgaacgccgacgaccctcaaaccgtcttcaccctggccaggggccaagagcgcgacctgcgcgactggctctaccaggagcggacgcccacggaccgctcagtcagttccgggctcaagcaaatcgcggcccagatcgaggacgagcacggacaaccaatcgacgtggtcacggtcggcgacgccctcccctccgcccagaccgacgccctcctggacgccgccaggcaggccctgctcaacgcggtcacgcacggtggtgaaccaatcgcgctctattgcgaagccggcaaatccaaagtggaggtgttcgtgcgcgaccacggcgacggattcgacccggcagccatcccgcccgaccggctgggcatccgccagtcgatcatcgggcgcatcgagcgacgcggcggtacagtggagattgtctccagacctggatggggcactgaggtgcgcatgcatatgcccatctccgcagccagccagagcgatcaagccaggccaggcacggcgacgcggacggcgaccgacgcgaaaaccagattggagtgagggctatggaagaggcgaggaaacaagcgggaccaggagcgcagaccccgcggacgcccctaaccgcaagcggcgctcctgcaaacgccccggaggatggcccggccgcatccgtcggcatgcgggacccaacccggattcgcgtaggcgtggtggacgatcacgagatgttccgcgccggggtcatcgccaccctggaaccctatttccccatcgtgggtcaggccgcggacgtggagtcatcagtggcgatgatcgcccagacccagcccgacgtggtcctcctggatgtgcatgtgcccggcggtcaaggcggaggcggcgctgaaatcctgacccgctcccagcccctggcccccaattcggttttcctggccctctcggtctccgattccccccaggatgtgggctcggtcatccgcgccggcgcacgcggctacgtgaccaagaccatctccgcaggcgacctggtctcctccatccgccaggtgcacgaaggctacgctgtcttctcccccaagttggcgggcttcgtcctctccgccttccaagacggcgcgagcgacgagggcccggcccatgacgatgagctggaccggctgtcgggccgcgaacaagaggtcatgcgcctcatcgcccgtggctacacctaccgggaggtggccagcgagcttttcatttcggtcaaaacggtggagacgcacgtttcctcggtcttgcgtaagctccagctctccaaccgctccgaactgacccgttgggccgtcgatcgccgcatcgtctgaccgccgactacagctccaaacccagagcgcgcaggtcctccctcagctgttgcgcgccacggaactccagcccgtggatgcccagcttccgagcggccgccacattcacaggcctgtcatccacgaacacgcagcgcccggcctccaatccaaagcgccgcagaagcagctggtaaatcagggggtccggtttgcgcaccatctcctcgcccgacgtcacaataccgtccaaccgtcgtatgggctcgaacttgtcgtgcagcaccaccgccgaggacccggaaatgttgctcagcccccacagacgcagcccgctcgcgcgcaaatcctccatcagcttttccattccggcgatcatcgcgggaaaggtccgctccacgtgcgcgaaataggtgcgcagcacccaggccacagccggcccgtggtcgctctcgtagtccgccagtatccgctcctggctccagccggcgtcggacaagtcgttgaaccgccagaagccccactcatcctccgggtccagcagcgcgtctatcaccccatccgggtactccccctccagggccagacgcggctgccagtccaccagcaccccgccgaagtcaaaaatcacgttgtccacaacgcccgcgttcgctccactcataccaccagcttaggccagcccaaacctgtgcctgtccgcccttccccagccaggcccgcccgcccttacgcccacagaataaggcctcagccgctcgattgacttcaagccgtctttaacttctatattgcttacatcaagccgttgggggcgcatccctgcaaagaaggagcagcatgaacacgcttgtcctggctttccatcccgagctggagtccggctcacgcatcacccaccgcctggcccaggccgcgcgacctgggaacgacctgaccttggtcgacgaatacgccctctaccccgactttcgcatcgatgtcgcggccgagcaggggcgcctgttggccgccgaccgtgtggtctggctcttccccatgcgttggtacagttcgcccgccctcttgaagcagtgggaggacgacgtgctggagcacggctgggcttacgggaccggcggcgacaagctccggggcaagcaactcctgctggccatctccatcggtgcgacggcggagaagtaccggcccgagggtgagttcgcggtcaggggcgccgacctgctgaccccttggcggaccacggcccgctataccggcatggactggcagcagcccttcctggttcatggcgccagctcaatcagcgacgctggactggaggaagccgcccgtgccttcgccgaacgcttgagccagtgacccgctgaatccctgggccacggagccgtcaggcaagacctttacccagcccttcacgcgccggccaagcgaggcggcgcgtgaaggacgcaagaccaccaacagcacaacaagcaagaaggcaaacgccatgcaatacaccaaattaggcaattccggcctggacgtctccaggatctgcctgggctccatgggattcggcacgcccggcaacgacatgttcccctgggcggtcggggccgaggattccgaggccgtggttaagcaagccctggacctgggcatcaacttcttcgacaccgcgaacatttactcctacggcgacagcgagcgctacctgggccaggcgctcaagaagaacgccaagcgcgacgaggtcgtcgtagccaccaaggttttcttcacccactccgacaagcccaaccagcatggcctgtcccgcaaggccatcatgcatcagatcgaccagagcctggagcgcctgtgcatggattacgtggatctgtacatcatccaccgctgggactaccgcactccgatcgaggagaccatggaggccctgcacgacctggtcaaggccggcaaagtgcgctacctgggggccagcgccatgtacgcctggcagttcgagaaggcccaattcgtcgccgcctcccataattggacgcccttcatctccatgcagagccatatgaacctgctctaccgggaggaggagcgcgagatgctgcccctatgccaggacgagaatgtggccgtcaccccctacagcccgctcgcctcgggtcgcctcacccgtcagtggagcgcccaaaccaagcggtaccagagcgaccaggtggcccgaggcaagtatgaccacaccgagagccaagacatggaaatagtcgagcgagtccaccatttggctggcaagtacgaggcgcccatggtccaggtggccctggcatggctccttcacaaaccgcaggtggccgcccccatcatcggcgcccacaagcccgaccacgtgcgcagcgcggtcgatgccctgaacctggatctgacccccgacgacatggcctacctggaggagccctacctcccccacaccgtcaccggcccctgggcgcccgaccagacggacttcacccgctgaccgggttcctcccccacgcaccgagacccctctccaggcataggccgggagggggtcgccgcttacatggtcagtcgctcgtcgatcagccgtttgagggcagggccttggtcatacgaacaggaaccaggagttcacgctccaccaaagctggtcgttgacccagttgcgggtttcgaaaacatacaggaaggcgcccaggacagcgatgaccaggccggccgtcgcgcagcccatcgcactgcgggagaaggcggacaggggcgccagcctggcctccggctcaggcccccgatccggcaatgcgagcggtccaccctcgccggaccttgcgccgatctcaccggccagggccgaatcgtccgcgtccccttgagcggaccggcgggagtcaaaagccaggaggcagcaggcgaagaccagcgcgagcgcccaaccgaaatccaggatgtagcgcatgctgtagcccgccgtgtgcgcggtgaaggcgtacatcagaaggccgatcgcgcctgtgagcgcgcagaaggcccccacctgccgttcacggagccgccgccagcagggcttgagggcgaagatgagcagggtgaagggagccagcagggtgaacaggccgccgtaactggcctgttcgggcagccagggcgacatgtcctggctggtgcgcagcaggaaggggaaggtggtggccaggttcggcggctggaaaaagtagagcaaggagaggggcactagctgcgagagcggcgaagaactgtgtggtatgtcgtaggcggtcaggttgtagttggccccaaagtcgagcgggcggccgaagcgggcggcgttataagccatcagcggggcggcgaccagcaggtaaggcgccagggcgcacaaccaggtcagcgcctcctcacgcaggcctttccccccgcgcaggccgcgctcccacaagtcccgaatctcgccccagaaaagcggcagggccaagagggaagcgagcacgaacgcaggccgactggccaggttcagcgccatgcataggcaaccggccagcagccagcccttattcagatcgcgcagtttcgactcgatccagcagcacagccccaggaaagtgaggctgattgaaagcgtctgcggcagttggtagaacacctcgctgtggagcacgtagaacatgggcgtgcagaagagcataccgctggcgatcagcagcacgcagcccaagctgaccgggtgcccccgacgggagaaccagcgggccacctgcacggtgaccgcaagggagcacaaggccaacaccagggcgaaagccagcacagccgaggatgcgggcaggtcttggcctgtcagcgcccggtagggcatgaaggcgataatggctggcagtacgccgaagtagctgtagtatttgcctgatttaaaggccacatcgaagaagatgggggtgccttgcgggtcctcgcgagccaaacgcatacgggtggccgtgtcgtaggggttgggcatctcggccagctgacggttgaccggcaggtccaggttgagccgcccgtgcaaaagcgccttggccaagtcgccgtattgattggaatcgaagaacatgtcgttgaacagtttgtggggcaccgtcgtggcggtcggcatcccgaagaccaaccacaagcccactatgccggccgcgtcgagggcgaacaccgccgccaggggcgccaggcagcgggggctgagggcgcggaaggggcggaggtagaggccgctgcctggcctgaacgcgaggatgatcacaatcagcagggcttccagcgcaagccgggaccagtccacgcggtatggcacccgcgggttgacgctcacatcatccaggggtatgacatcgccggagcgcacctggtagtggaagcgcaccgcgttcgcgccgtcgccgacgtgcaggtagcgcgaccgcggagccccggtggagtactgatggacgctggtggcgtcgtaccaaccaccgtcggtgcgcttacgggtcgagagcttccacgacagggcctggttggacacggccccggattgggcgctcaggtttgcggccgggcgcaagtacaggtagcggatcggctgcgggctcgatacgtcgcgccaggcgccatgcgggtcgatgacggtggccgtcccccgatcggggtgggccaccagcccggggcccagcgacgagcggcccgcctccgtgtcatcgcccaggctgcgccaaaagggcatattcgccacgaagacctcaaggcagacgaagaccgctatgagcgcgattgggacgagcatcctgcgttctgaagagcggaggtttttctccaaccattgtggaatttccctcacccgccctacacgcataggcgacatcttaatggaacccgcgaacttggcgaccttgcaagggaccgggcgaccgccacccttgcgcccagcatgcagcgtgcgagggagggcgacggcctactcgcatatgacggcgcggatgccggccggcgtccacacgaacgccggataaaaaggggcttccgacgctcagccggaaaccccgtttgcggacagggcgggattcgaacccgcggaacttgcgttcaacggttttcaagaccgtctctttcgaccgctcagacacctgtcctcgaccgcctacacgaggcgatgcctctctagtttagcggtcacggcttacaatccgctgggctcgactcgccgagccgcgaatcgggcaggtctttggtgtcggtcgtaatcgcgccctcttcgaacgtcaggaagcgggtgcaggttttcaaaaggaattcgcggtcgtgggagatgaccaagacgatagcccccaaggaacgcaagtatccaatcgactcggtcacttcgttcatgtgggtcaggtccagaccgctggtcggctcgtccatgatcacgatccgcttgccggacagcacggcgcaccccaccgccacccgctgcttctgcccgcctgagagcggattcggattacggtccaacaggtcggtcaaacccaggcgggccgccacttcctccacccgcgcctgatcgaccccgacggctccaagccgcagctccttggccacactctcgctgaagagctggtagttgacgtcttggaagaccaggaaggaggcccgggtcaggtccttgcggcccagcctgcggccatccaggctgacgcgcgcgcccttggcccctgtgataagcccggtcagggccttggcgaaggtggatttaccggcgccattgcgccccacgatgccaatgacatcgcgcccgtccatctccaggtcatcgacgcgcaaagccgcccgatccgccccgtggtaggtgtaggagaggtcgtggatacgcagcgtgtgggctggtgcgtcatcaggagggacggcgggagcggcggcgtccgggccggcggtcggcagggtgagtgcgcgcaggcccagccgttcacgggcgggcgcgtccagggccgccatctggcccggctcaaattcatgactgaccctgccctggtccatgaccacgaaccggtcagccaagtcacgcaggtagtaaagccggtgctcgataatcaccatcgtcatgccccgctccttgagcatggccagcacacggcccagggattcgatggctcgggcgtccaggttggacgagggctcgtccaatagcaggagcttggggccgggcatgcaggccgaggcgatggcgaccagctgcttctccccgccggacagggcgaacatgctcctatccagaaaccgccggatgccgaataaatccgccacttggtccaggcgggcgcggatactggcccggtccacccccgcgttctccagcggaaaagccagttcgctggtcacgtcggtggtgaagaactgggttttgggatcctggaacactgaccccacccgccgggagagctgggagatgggcgtgctgccagtggacaggcagtccaccaggcactccccttccagaccaccttcgtaaagttccggaatcaggccgttgatcacccgcgagagcgtcgtcttcccacaaccggacttgccagtgaccaccagcgcctggccggccggggacttcaggctcacccggtcgagcgcgggctgctcctggcccgaatacgtgaatgaggcgttgcgcagatcaagcataggcaaggcaccccagcagccccagacccacgatcaggcagaccaggtcgctggagaacaccgacagaccgtacagggaggtcttgcgctgtggatcagccaggccccgggtcagggccgcagcggtcaggtcgcccgccacgtttgaggcgttgttcagcaaaggcacgtagatgtactccatgctgcgcaagggatggagggccaggtcggagccattgaccgcgatgccccggaatttcatcgcgtcacgaatctgatggtagtcgtggcggatagtgggaaagaagcggaagagcacgctcatcggcacaaccacccactgcggcaggcgcaaggtccgcagcccgtacaccagttcggagacgcgagtggtggagaaaatcagcgcggccacgaccacgaccggaagcatctttcccagggccgagaagaggaaaagcaggtaatggcccagcaagttgtcggggtagagcaggacgcaggcatcaccggccacgaaaaccgcgcaaaccgccaaccacatgcccgcctgacgccagcgccgggccggtaggaagagcaggcataagtaggcgtaggaggcggcttgcaaccagatgggcaggttgaagaacaggagcgcgttcgcaaagaccaccagaaagaatttgctgaatatgcacaccggcctcatcccttggccgccccttccgagaagtgcttggagaccagccgctggcctatccaagcgccgaccaaggcgccgacgaccgtgatggccaggcaggcgatcaaggtgggggcggtgacgtgggagaagagggcgttgatatagtcccggctcttaccgcgcttgaccaggctggccacgtaggcgttcttcatgaaccacaggggcaggaccgggcccagcgaaccgaaggtgaagaccaggtaactcaggacccgccaggggatgtggacgctgccacggttcagaccggtttcgaccaggtcggcgagcagaccgcacaggacgtaagggatgaaggccagggcgaagtggccggaaatcaggaagaagaggcccatcagcacgcccatgatggtcagcgccccgaagcgcggcaccttgcggcacatgagcatatagaccggtcccgccagcaggccgacgatgccagggacgaaaatcgaggtgaagccgggcaggagcaggcctgtgaccagggtggtcaacccctcggccaggcccatgcagataaagtagagggcgctgtaaatcccgacgttaatcaggtccttggtctttaaagccgcgaatccgcccatgatcatgcttccgcccgcgccttttggcccgctgaatccccgccgcgacagatgccgcagccacttgtctcacttaccagcctatgggaccgccagccgcctggcaagggtcattttccgctttccctgggcgaggagcggtatgcctaccgtttgcttataaggccattacccgtcgggcggaccgcgcaaggaggcctggatgcgaaacatcccgcgccccgcgtttcgcctgatggctcgcgcgtgagcacgggatgtcgctcgggaaaaccgggagagtctcaggcctcccactgagtgggctcgatgacttccttgccgcccatgtacggccggaaggcctcgggaatggtgatggagccgtccttgttctggtggttctccaggatggcgaccagccagcgggtggtggccagcgtgccattcagggtggagaccgcgcgggtgccgccgtcggccgtgcgctcacgcacgttcaggcgacgggcctggtactcggtgcagttcgaggtggaggtcaactcgcggtagcgctcctgggtgggcacccaggcttcgcagtcgaacttgcgggcggcggaggagcccaagtcgccagcggcggtgtcgatgatgcggtagggcacctcgacctttgccagcatctcctgctccatagccagcagttgctggtgctggtcgcgggaatcctcctgcttgcagtagacgaacatctcgactttgtcgaactggtggacgcggatgatgccggtcgtgtccttgccagcggcgccagcctcgcggcggtagcacgtggaccagccgcagtagcgcagggggccggactccaaatccaaaatctcatcctcgtgcataccggccagggacacctcggaggtgccgaccaagtactggtcgtcgggctcgcgcaggcggtagatctcctcggcgtgggagttgaggaagccggtgccggccataacctcgggacgcaccagggtgggggtgatcgtggggatgaagccgtgctccatcgcctgatccaccgccatggtcagcatggcgatttccatgcgggccacgtcgccgcgcaggaagtagaaacgggaaccggaaatcttgacgccgcgccgcatatcgatgccagccacgccctcgcccagctccaggtggttcttaggctcgaagccctcggccttgaagtcgcggggagtgccgaccttcttgacgaccacatagtcgtcttctccaccggcgggggcctcaggctcgacgatgttgctgaacttccacatagcggtcgtgtaggcctcgtccgcagcgtcggccttggacttgtactcgctgacctgatcggaaagcttcttcgtcctctccaggagtgaggacttttcatccgcagaagccgaggcgacctgcttgcccagctccttctgctcggcccgggacgactcgtaggcctgcaaggcctcacgacgctccgagtcggcgcgcagcacttcgtcgaccagttcgacggactccccgcgctttcgctgggagtccttgacgatgtccgcgtggtcgcggatgaattgtatatctaacatggtttaatcctactcccgtaaggggacaggcggcttaatacgaccccatcctcggcccgtacaatccccgccgactgccatctcaactgccttattcctgtaggctcggttcaccctacagcttctatagtaagcccaagatacgcggcgggggcgcgccccgcgcaaaacgacggaacgcgcccctgcccccgaaaaacggccagactcagttgaagagcatgacgatgttgtagaagatggcgctcacggcgatcaggccgatgatcacgacgaacacgttgctggccttgcccgagtacttcttgagcgaggggaccgtgtgaatcgcgtacataggcatgaggaagagcacgaaggcgatgatcgggccgatcatggtctcgatcatgttcatcaccgaaaagttggcccaggcgacgagccacgcgcacaccaggatgatgccttccacgcagatggtcatgaccttatcggagacctgcttgccggacttcttcgcgatcttgcggatgatgccggacaggccctcgctggtgcccaggtagtggcccaggaaggacttggcgatggcgatgaaggagatcagcggcgccacgatcgaaatcagcgggttgttgaactggttagctatgtaggacaggatcgagatgttctgggccttggcctcggccagctgggcagggcccaggcacagcacgcaggagaagacgaagaacataaccacgcagaccatcatcagctcggcccgctgcaggaccttggtgaccttctggtccacgtactcgtcgccgtactcctcgcgctcggccacagagaaggaggagatgatcggggagtggttgaaggcgaacaccatgacggggatcagcagccacaggccctcaagcagcccggtgaaggagaagccgccagaagcgttgcgcgggaaagaggtgaagatgctggtgttccagtgggggatcaggtacagggcgaacagcaccagcacgatcacgaacgggtagaccaggatcgacatgaccttagtggtcaccgtcgtgcccaggcgcacgatcagcatcagcacgacgaccaggaccagggaaagcagccaacgcggcggcgcgcccatgtgcatctggttgacgatgaagctctcggtggtgttggtgatcgaaatgccgtagaccagcaggatcgggaagatcgacaggaagtagatgatggtgaagaccaggccgaagttccagccccagtgctgctcgaccacatcagtgatgtcgtcgcccgggttcttggccgagagcacgaagcggctcatggcccggtgggcgaagaaggtcgtcgggaaggcgatgatggtcatgaacacgaggccgatgatgcccgcactacccgcgtcgatgggcaggaagaggacgcccgcgccgatggctgtgccgaacaggctcagcatccacgtggtatcgcctttatgccacttactggcatactccttagtgccttttacctcagatgggtcctgaggtgaggtcgctgccttgttttccatattgtgcagtatccctttcttgctctcacaacagatattcatcaatgaccaacccagcaccgtcaaaacgccgccaggacaagccaatgcctcttattgcaatagtattcgcgagcgattgcgcactcccgatttgtccactatttgtcacttgccgaagatggtcctgcggaagccctcaccggtcggcgtgccggccaaaccaccgatgccggtttcccgcagggatgctggcaggttcttacccacctggcgcatggccacgatgacctcgtcggccgggatcttgttggtcccaccagccagggctatgtcagccgcgatgagggcgttgcccgcaccgatagcgttgcgcttgacgcagggcagctccaccaggcccgcgacggggtcgcacaccaatcccagcaagttgctcatggcgatggcgaaagcctcagccgacatgttcgcatcgccgccggcagcctccaccgccgccgcagcgcccatggcggaagcggaaccgacctcggcctggcaaccgccggtcgcccccgcgatcatcgcgttgttcgccacgaccatgccgaaggccccggctgcgaagagaaaacgaatctgcccttccctaggcagttccagccgccgtttcagggccgccagcacaccgggcagggtgcctgacgaccccgcggtcggggtggcgcaaatgacgcccatggaggcgttgacctcgttggtggctatagccgcttgcacagcctccatcatcacgtcgccggacaagctcaccttgtttttgcgatagtccctgagcagggccgcttcgccgccggtcagcccggtctgcgagaagacgcctttgtccgtggagcccttgacgaccgccgcatccattgtgtccaggttcttcgccatgcgatcccagacctgctcgcgctcttcgccgtagcgttccatttcgtcgcgaatcataatctccgagacaggcagattctcccgctcgctggtttccactaattccttgaccgagttgaacatcttccctgactcctaactgatgtacgagatacgggacgagtgactcgcgaagtccttgacggtttgagcggtcagcggtttgtccaaatcaaaggcgtacatggtcttccctctctcttcatcacagcattcgctacatccgccgagcacgcccaagctggcgagcttgtccgcgatcggtttcacttcgtcctcgcatgtctggccggtgcccggctcctcgacgagcaggaagggcagcaacccgccaggctggatgtcgaagccgtccgcttggatccgccggatctcaatcgtgccgccaccgatcgagcaaccggacacggtcacctggcggccgtccttggtcatctccaaaatcgcggtgttagggtgcttgatcgggctgtcaccctgctcctcaacgaaccggatgtcaatgccctggccgcgggcgatgtcgaccgcctgcggcaccctgctgtcgtccggctcgaagcccagcaggcccgagacgatcgcataatccgtcccgtggcccttgtgggtctgcgcgaaggattcgtagtatcgaatcacagccttatccggcgggccaccgatgatgctgttggccgccctgccgatagccaccgcgcccgcggtatgcgagctcgaaggaccgatcatcacggggcctatgatgtcgaacacgctcttgtagttctgtgacatcgcacgtcctttcactgcctagcactgcttcaacacaccgcacgtcatgcctgtaaccaggcacttcctcccaggcaggacggacccggtactggcccatgccgccgctcgccttgtcacatttcagcctgctcccttggagacggtgatgattgtcacaccatcatgagacatcaatcacatccttagcgtaagccttttccattacatccgactcccgggcgttccgcccccctccgaaccgcttacgtgcaggaatcgttgacgttcaagccctcctgctccctcagcccgcccgaacgcggaaaatggagatcatgccattatcagcgatcgtcgtccttgccggggtggtctgcgtcatcgcggccttggcggctctggcgctttggctgcgcgcccgcgcccgccgccggctcgaggccagcctccaggccaggcacgatgacggtgaccgcgtctcctacgctttcgtgatcaacccctccaagccccaggccgagcaggcacgcggactgatcaaggatttctgcggggccaagggcctggacgacgtgcgtttctacgacacccagctcgacaaggacggcaaggcctgcgcgctccaagccgtggacgagggcgcggacatcgtggtggcggtcggcggcgacggcacggtgcgcacggtcgcgagcgccgtggccagcaccggccacaccctgggcatcgttccaatcggcacgggcaacttgttcgcgcgcaatctgaacatcccagtcggcgacatggacgcggccttggctgtagccacctcgcacggctcgcgcctggtcgacgtgggccggatgaggatcctggactcatcctcccctcaaaccaagcacgccttcctgatcatcgcgggcatcggcttcgacgcgatgatgatagacgacacggaccccaacctgaaaaagagcatctcctggctggcctatttcatctccggcgccaagcacctgttcgccgacaaataccacggcgacgtgaccatccgccaacccgacgggcgctcccagaccaacaaggacgtggagttccgcaccttcatggccggcaactgcggcgagatcccaggtttctcgctgatgccagacgcctccttcgacgacgggatactggacttcgagctgattgacacctccggcgggctgatcggctgggccaacctcttcggcgacgtgatgcaccagaccatcacccgcaagcccaaccagagccccctgtccacgaactcctcaatcgtgcaggtgcagggctccagcgccagcatacggttgaaggaaccggccctggcccaagtggacggcgacatcctggggcagacccagcacatcgagctgaccgtggaccatcaggccctgtgcgtgcgggtgccggtggactgaggcattggccgggcggcttgcatggctgctgaaaccaccgctccgcttggttgagctgtgcatacttgtgagatttcgttgtgtattgtgcgattttcggtcaccctcgcatgcgataataagaggcatggttgctatcaatgcgggacagcccgccaccccagcagatttgattgatgtcaacgaggtcgtcggcaaatattacgacctggtcccagataccggcgaggccgcccagcgcgtctcctttggcacgtccggccaccgcggctcctcgctgacctcctccttcaacgaggcccacatcgtcgccatctcccaggccatcgccgagcagcgggccaaggaaggcgtcaccggaccgctctacctgggccgtgacacccatgcgctctccctgccggcatggaagaccgccatcgaggtgctggtcgccaacggcgtgcgagtgcgcatcgacgctcgcgacgactacacgcccacccccaccatctcccaagccatcctgacccacaaccgggccaaggacggctcccagcggttcactggcgacgacctggccgacggcatcgtcgtcacgccctcccataacccgcccaccgacggcggtttcaaatacgatccgcccaccggcggcccagcgcccgagtccaccacccaggccatagccaagcgcgccaacgagctcctgggctcctaccgccaggtcaagcgcatccccttcgaacaggcggtcaagtcagatttggtggagcgcttcgactaccgcgagcactacgtgtccgacctgaacaaggtaatcgactttgacgccatccgcgcttcgggcgtgcgcctgggcatcgaccccctgggcggcgcttcggtcaactattggccgctgatcaacgaacaatacggcctgaacatcggcgtgctgaacgaaggcgtggaccccacctggcggttcatgaccatcgaccacgacggcaagatacgcatggacccctcctccccctacgccatgcgcggcctggtggagcggctggacgccggcgcctgggactcctacgacctggtgggcggcaccgaccctgacgccgaccgccacggcatcgtctgccctggatcgggggtcatgaaccccaaccattacatcgccgtgtgcgtggaatacctcttctccggccaccggcccgactggccctccgagtctggagtaggcaagaccctggtctcgtcctcgctgattgaccgggtggcagcctccatcggcgccaagctcgtggaggtgccggtcgggttcaagtggttcgtggacccgcttttcaagggccaagtggcctttggcggcgaggagagctccggcatgagcttcctgcgcttcgacggccacgtgtggaccactgacaaggacgggctgattcccgaccttctggcggccgagataacagccaagaccggcaagaacccggcccagctgcaccagtcccaggtggagcgctttggcgaaagctggtatcagcgggtcgatacgcccaccagcctggagcagaaagccaagttcggcgccctgaccccggcggacgtgaccgagaccaagctggccggacagcccatcaccgccaagctgaccgaagcgcccggcaacggcgccaagatcggcggcatcaaggtgaccacggccgacaactggttcgctgcccgcccctccggcaccgagaacatctacaaggtctacgccgaatccttcgtctccccggattccctggcccaagtcctcaccgaagccgacgaggtggttggccaggccctttctgactgaaagcagcgcaggcaaagctggaggccgcttccccaggcaggggtacggcctccagcttttcaggtgaaccatctaaagtagagggtatgaccgaagatcagattgtcgtttccaccgacggatcggccctgggcaacccgaatgggcctatggggtggggctgggtcgaccaccagggcggtggccaggacgccggcggggccaccaatggcaccaaccagattggcgagctgtgcgcggttctgcaagccctgcgcgcccaccccggctccatgccgctgaccattcaaaccgattcccaatacgcgatcaactgctccaccaagtgggtggcaggatggaggaagaagggctggcgcaacgccgccggcaaaccggtcaagaaccgggcgctgatcgaggcgatcgaccaggagcttcgccagcgccagggaccggtcaggttcttctgggtcaagggccacgccggcgagcgcttcaacgagcaggtcgacgacctggcacgcggttacgcctcagccgcacgggccggcaccaagcgctcctacctgcctttggagggctggcagtccctgctggcttccccctacaccaaggggctcaagatttccgaggaggtccgcctgcaacttaaggggcaaggcgtcgccccccccacaagcgcagtcagcgccgggagcggccagctgccaaccgacgaagccgaggtcgcgggcgacgacgaccgtccagagcggcccatgcccatccagcagccgctggacgcgcagacggacctgccggacgagaccgaaatcttggatgacgaagccaggaccgagattatagaaccagtgggcggcgctgcaggtcaagccgagattcaggaatctgacgacgaccaggccgagacgggcgaggacgaagcgggcgagggcaccgaaagcgccgaaccagcgcgcggcctgaccgcctccggcgacttgaccatcacccctcccccatcgagctcaccctacttcgccgataaagcgctccacgtctcgggctcaatcaccttcgaagcggacatcgaccaaaagggccgggtgcacatatccgcccccttccgcttgcactcaatcaccgagcgcgacactggcgacggcggcgagcaactcgacagcccacagttttagactaatttagattcagtccaatacggcagagcgccagtccagtggcgcgtaaaggagattgcatggataaggcacagcaggacgcgttgaaaaaggctgcgggcattgaggccgcgaagctggtggaggacggcatgatcgccggcctgggcaccggttcgaccgtccgcttcctggtggacgagctaggccgccgtgtgcaggaggagggactgcgcttcaccggcgtcaccacctcccgccgcacccaggagcaggccgagggctacggcatcacgatcgtggacgtggacgacgtggaccgcatcgacgtgaccatcgacggcgcggacgaggtggataggaacttcaacggaatcaaaggcggtggcgccgccctcctctgggagaagatcgtggccaccaactccgataagatcgtctggatcgtggacgagtccaaggtggtggacaccatcggcgccttccccctgccggtcgaggtcatccccttcggcgccggccatgtcatcaagcgtttcgaggaccgcggctacaagcccgtcctgcgcaagaccgctgacggcaaggaggtgcgcaccgatgagaacaacttcgtggtggacctgcacctgggacgcatcgaccacccccaggacctggccgaggacctgatcaacacggtcggcgtggtcgagcacgggctcttcctcaacatggtggacaccgtcatcatcggcgacccccacggccccaggattctgagcaactccaacaagtaggctttaacaccaggcgagcgccccaccgaccatccgacgggcggggcgctcgcttattgctaccgcgcggcaggtggagcatcgacccgacaacgattcccagcgggccgtaggccgtcggacgcactgcggtcagtagccggcatcagccttgatcccatgcttggcgttgaacgccttggcatccttgtcggctttgatgcctcctacaaccaacagcaaccaaagcgcaagcatcaagagcatcagcaaagcaaaggcccagtcagcgatcctcatcacgctgtggaccgccaggcacccggcgacgaccaccagcgcggacaaacccgagagcatggccatgcccagaaagaccgccgcatacctgtggtggacgtactcccaggtctcgtcggaagccatgatggccggggtgcgcagacccgccgcggagttgcgcgtcaaacgacccttcctggcacccatatacatccagcccgccagagccgctaccgccgtgaaaagaaccgccacaatgaccattgctacctcctcgccccgatttgcgggcactcccctgtaccgccagcggtcagtccaaggcttccacggcttggcgggcggcctggtagtcgggctcgtcatggacctcggccacctgctgggtgtaagccacctttcctccccgatcgatgacgaccacgcatcgggagagcagaccctgcattggaccctcagcaatggtcaccccgtagtcctggccgaagcttgagcggaaggccgacgccgcctgggcgtccttgatgccctcggccccgcagaagcgaccaagcgcgaagggcagatccatggagacgcacaggaccgaagcgtcatccagctcctgggccatctggttgaacttgcgcaccgacatggagcacacaccggtgtccaaggaagggaagatgctgaggatcagcttgcggccagtgaaggaggaggagacgacatcattcaaatcctcaccagccagggtgaaggccggggccgggccgccgacctcggggagggttcctaccgttgctgtgggagtgccacctacttgtatttgtgccatgaaactatcatcgcacacaaaccgtccccacgcagcaccccgcttcagtggactgcgacaatggacgaccatgaaaaaaggccagcgccgtaacgacactgaccttcatgcaccctgctcgacccatgcgccggaactccctggggagcaatccagccatacggctcgggggcttcacgaaccgtgggagcgctactacttgcgctggtggcgggtcttacgcagcattttgcggtgcttcttcttgctcatacgcttgcggcgcttcttgatgacagaccccatccgagcctccgttccttaacatctgatggtaagtgtgcaactcgccctataatacaccggttcagggacctttatagggggaaagcctggtagaaggcgtcaaccgaggccttgggcccctcggcttggaagatcgccgtggcgttgcgccacacgacgactgccctcttggcgtccccgtcaacctcatgctcactgtatgatccggtggctttgccggagaccttgaccttgcccgaagccagctctttaccatgctgggcggcggccagggcctcgtactgcttgctggcgtcctcctcctggctccactgggccacgcggagggtcacatccttcgcggcggcaccagtcgagtaggtcaactgatactcctccagcggcgatgcggactgccagtccgcggccgcctgggcattgagacgggcgaaggccccgaccgaatccggcatggccttgagcaggtcggaagcgccctggggcaaaggctgggccttaatggtcggttgagtctgcgagggtgcgacatcgccacccgtcgaggagctggcggcgggcacagcggtggaacttcggggcgcccagtggggccacacgaaagcggagaagaggaccaggatcacgatgacggcggcaccgatgaccacgcttaagcggcggcggcggacggctgccgtctggctttgcggtttaacctcaggcttgttttcaggcatactccgattctctcacaagggctttgaacggctcgtgtagggtccgcgaaaacttgcatgaaaaaggaccggccaccatcggcgcgcacgcttggtccagggctggtcaggcgatgccgtcaagggccttgcgccggcgatgaagggcctgccgccttgtccttcaagaccgatagcgtcacaaatatggcgaaaagcgcaacgcagtatgtatgcaccgaatgcggctggaccggagccaagtggttcggccgctgcccggagtgcggtcagtggggcacgatcgaggagttccatgaggcccggcccggcaagacgcgctcgcccggcgcttccaattcgagcggccggcgaacccaggcgtcggtcctgtccgccgaggcccaggcccagcccatcagtcaggtggggtcagagtcggtggagcgcgtacctaccggttttgaggagttcgaccgcgtgctgggcggcggcgtggttcccggttcggtgatgctggtggccggcgaacccggcatcggcaaatcgaccctcctcttggagacggccggcaatgtggcccgcagccagcccggcagcgtgctctacatctccggcgaggagtcccaggcccaggtgcggatgcgagcctcccgggtgggcgccatcgacgattccctgctcctggcggccaccaccgacctgggcacggtcctgggcctgatcgagcagaccaagccctccctggccatcgtggattcggcccagaccatcacctctcaggacgtggacggcatctccggcggctccacccaggtccgcgaggtagcttccgccctgattgatttggccaaaacgtacgatattccagtcatgctggtagggcatgtcactaaagacggcgccatcgccggtccgcgcacgctagagcacctggtggatgtggtctgccagttcgagggcgactcccagacggccctgcgcatgctccacgcggccaagaaccgcttcggccccaccgacgaggtgggctgtttcgacatgagcggccaaggcatcgaggaggtcaaggacccggccaggctcttcctgtccgcctcagaggccccagtcgaaggcacctgcgtcacattcacccttgacggccaccgcagcctacccatcgaaatccaggcgctggtcaccgcgtcagtcctgcccaccccccgccgcaacgccaatggcatcgacgctaaccgactggccatgctggccgcagtgctctaccggcatggcaaggtgaacctgctcacccgcgatttgtatgtgtccacaatcgccggtggcctggccaaggagcccggctgcgacctggccgtagcggccgccctggcttcggccaactcggccaagccgatcgccaagaccacctgcgccatcggtgaaatctccctgaccggccaagtgcgcccggtcccccagctggcccaccgcttgagtgaggcggcccgcctgggcttcacccgcgccgtcgtccccgtccaccggggcggccgcgcgaccaagccctccgccggtttagaggtcatcgaagtctccaccttggccgacgccttggaagccctaggcgcgcgttaagcagtcccaggcgtaacgtccaatgaaggaacccaccgcaagaaccccacacgaaaggaaacccgcacatgagcgtcgaactggaatccatgagcccctacgcccagtccctggtcaagcgcctgggcctggaaccccacccggaaggcggatggtacgtggctgattggctgagtccacgcgaagacgcaccctcggcccgccccctgagctcgctgatttacttcctgctggcccagggcgacgcttccgcctggcacaaggtggacgcggacgaaatctggctctggcacggccccgcgacggtccaacttgagatcggcggctacggcgacgccccggcccaggaccagaacgaccacgaactcatcaccctgggctcccagatcgcccacggcggctccaccgacgagaccaccccagtgggccattacgtcgttcccgaaggttgctggcagcgaaccctcccaggctccggcgacgccctggtctcttgcgtggtctcccccggcttcactttcgcaggttttgagttggagcagtaaccccgttcccctgcccccccccccgacttaggcataggggcctgccaaggattcagccccgtgaccttccgcctgccgccgtatgatcggagccttggtaagcgtctgcccaactccccagctccgccggcgaccctcaggctgaggtgaggtcgcccacgtcgagctgataaagctggcggaagcgcgggttgtcccggtagagcgcagatggggtaccttgcatggcgatacggccgtcctcaaggaagaccacctggtcagcgccctccaggccctgcaggtggtgggtcacccacaggagagtgcggcccgcggtagccttcatgatcatggtcatgagttcctgctcggtgacagggtccaggcctatggtcggctcgtccaacaggacgatcggggtgtccttcagcacgatccgagccagggccaggcgctgtcgctggccgccggagaagcgggcgccgccctcctgcaccggggtgtcgagcccgagcggcagggagtggacatagtcggccatctgcacggcctccaaggcctgccagatttgctcatccgaagcttccggctcgcctagacggacgttcgagacgattgtggtgttgaagaggaaaggctgctggttcaggtagccgaagagacgggcacgctcggattgaagggctgcgattggttgcccgttcacgctgatccgcccgctctgtggggccagatcgcccagcagcagttgcaggatcgtggtcttgccctcgccggaaggccctaggagggcgattttgctgccagccggtatgcgcagggacacgtcatccagcagggtgggctggccggggccataggcgaaggtcacgtgatcgaagtcgatcgaagccacaggctccttgagcataacctgctcgatgggcgcgctctggcgggcctccaccctcgcggtcaagccgttcaagtggcccagggagtcggtgtaaagcggaacctccgcgacggcttgggatacgacgatgaagcaatcgatcagtgggaaaaggctcaacaccacggccgcagcgtagtcagcgagcgaatcggaggaggtgagcgtcagttggctgcccgccagcaggccaaccaccatgatgccgaatatcatctggatggcgaaattacgccagcgctcgaagcgtttttgctgcaactggctgtccatcacacggctgaaatcctcggccccggtggcggtgaactcgccgtggcggtgggtgatgacccagtcggacaagccaaggtagctctcggtcacctgcgtgtactcgtcttgctgccgggccttctccagcgcgtagtggccgtccgcgaaagccagggagaccagcgggatcaggatcagaatcagcgcgaagaggctgaagagcaggagggaggcctgccaggagaacacaccgacggctatggtgaccaccaaccacatgaggtaggcgacgacggtagggaagatggtgcgcagatagaagttctccaggtggtccaggtcgtcggccagcatcgagaggacggtgccggtgcgctcgtgctcggtcaagaaggaggcgtccttggacagggtgcggtagagctgcacgcgcagcttggagaccacgcgcaagacccaatcgtggctgcgggtgcgctccaagtacttgaacgtgggcctgccgataccgaaggcccgggtcaggacgatcggcacgtagaccacgaagatgttgtagggatggcgggccgaacggctaatcaggaaaccggaggtgaacatgagcccggcggcgcacacgaaggtgatggtccccaggaagaaaatcagggcgagcaggcccttattgagcttcagataaggccagaaccagtgatccttgcgccaggcggcaagatagtcggggcgggaccggcgctgctcttgcggctcggactgggccggccgggtctgcgcggtcagctggctgggctcggggccgttgaaaggcttagtcgaggtatccggcaatctgattgcctcccatccgctcgatcaactggtccagaggcccgccttggccgatcaaatcctttggcgcgccctgggcagctatccgcccctggtccagcatgatgacctggtccgcgtccgcaagccagtgcaagcggtgggtagcgaagatgaccaggtgcccctccatgatcggcaaaagggtctgcttcaagtcgtactcggtctcgatgtccaaatgggcggtcggctcatcgaagagcaggatttcacgggtggagtccagcagcacacgggccaaggatatgcgctgggcctggccgccggagatgccccggtgcccctcccctatctgagtgcccagaccctcaggcaggacgcccagccagtcgtccaaaccggcttgggtagctgcttgggcgatggccgaatcgtcggcctcctgggcgtagaaacgaatgttgtcggctatggagccggagaaaatataagggtcctgcggaatgtaggcgatatgccgctgccaggacggtgcgttgaagtggcccatgcttcgcccgtccaactcgatcgagccggaggacggggcgttgaagccagccagcagttgcaccagggtggacttgccggcgccggaacggccgatgaccgccaccttgctgtaacccttgagggtaaagcccaaatcggtcagcgcgggctctatcggctcggaagcctcctgctccccttccttcgaggcggccgggttcttactggaggaagcggccttccccgcaggcaccacggcgtccgcttggggcttggttggataagtgaagttcaggccgcgcacggtcagctggctgtcctcgccccagccgtcccagtccaaacggtcgtcttgcttgggctcgggctgggacaggaggtcctgcatgtccgtcaaggcgttcttgccgtccagggtggcgtggtagtcgtcgccgaactgccggatgggcaggaagtaatcaggcgccagaatcagggccagcagggaagggaagaggtcagccgtgccgtcaatcagccggttgcctaagaatacggccatcatcgctatggccaaggtggtgaagaagtcaagcgcgaacgtagaggtcagcgccacacgaatcaccgacatggtgcgtttacggaaccggtcggatgtcgattcgatctcgctctcgtactcctcgctgatgcccagcattttgagcgtgggcagccccaggatcgtgtcgacgaagcgggtgttgagcttacggaactgagcgtactgcttgttggagcgatcacgggcggccaggcccaggatcgccaggaagaagaagagcaggggcagcatgcatagcaggatgatcccgctcaaggggctttggctccagataagcaccagggtgatcagcgggatgaaggtcatgtccatcatcttgggcaggaccgtctggatataggtcttgacctcgtcgagcccgtcgatcagcatggtgaccgcggagcctgtgccccgttgggtcagagccgccggacccaagcgaaagactttctcctgcacttgcgggcgcaactgccggactgcgccatccgcgtaggaggtggccatgcgttgcttggccacctcgatcagttggcggaccgtgaaagcgaccaggaaggcaagggcgggcagcaacagggcggacatgggccgcctgtgccaaatgcgcaccagggcccaggtcaaccctgccgcttgccctgaaatggccgccccttgaaggatggagagcaaggccaaagccagcatctcccgcctgataccggcgaaccgaaaaaggctcttatcaatcaaagggcatgccttcccaggttgtaatcaacgttcgcgccaagctgcgacctgcctcagccagccacgaccgccggacgcacgtcagtcatgctcacatcgtcggagacgaggcgcttgcgctggatgaagtaggaccagatgaagtaggccagcataatgggcaggaagatgcacagcacgatggtcatgatcttcaaggtgtagggcgaagcggcggcgtccttgatcagcaggtccttcgacggatccgtcgccaccatgactcgggggaagatgccgttgaaaatccaagcgatcagggccatcagcgtcacgccagtcgcggtgaaagcgtaaccgccccgcttcttgaaggtgctgacatgaccgcaaatcgtggccgccagaatcacaacggtcagcaaccaagtgctgacaggacgcaagcggtagaagtcggtcatgaacatggccaggaccacgaagatcaccagggccgggtaagcgatccagtagagcttctccgaggtgttgagcatccggcgggagtcgccaggccccagcttcaggctcaggaagtgcaggccatgcaggaagcagaagaatacgaccgctaccccaccgaccactgagagccagttgaagacgccgaagaaaccgacccaggcgttgccttggtcatccatgggaacgccctggatgaaggaggtcagcatcatgcccaggaagaagggcgcgaagaaggagccaatgaagttggcccactgccatacgcccctctcccggtccgtaatcgcgttgttggcgaactcgaatgatacgccgcgtaggatcagcgccaccaagaccaggaagagcaggaggtaataaccggagaagagggaggcgtaccacagggggaaggccgcgaacatggcgccgccagccgtgatcagccaaacctcattaccgtcccaatgggggccgatggcccgcatgaagagcgctcgttcgtcaccgtccctcgccaggaagcgggtcgccatgcccacgccgaagtcaaagccctccagcaaaaggaacccggcgaagagcagaccgataacgaagaaccacataccttgcaggaagctcatgctaatgccaccttcctttcagcggcgccggacacatgggcggcagactcgtcaccctggtccgtctcataataaggaccctgatggaggacgcggcgggtgtagaagaccatcaccaagcccaggaccaggaagagcaggaagtagacgatcaccgaaaagaggacctcaggcgccgtggtcgtcggtgagacagcgtccgcgattgtctgataaccgtacacgatccaggggtagcggcccatctccgtaaccatccaacccgaagtgctggccaggaagggagcgaaggtcaggatgcccatcacccacagcttccatcggctggtccacatggtgttctttttcttccgtgtgaaccaaagcaccagagccgacaccaccgcaaaggcgaagccgatgcccgccatcattctgaagacccagaagagcgtggtggtcggcaggtagtagttcatatccttgccgaacttggcgtcatacttggagtgcagctcctggttgaccgcgtccatgcccttgaccgaaccggactccttgccgtagtagagcatagagccaaagccaggcacctccacggccttctcgaccttgtggtccttctcgttaatcaaggccacggcctgccagggggcggggtcgccggtgttgtcgtagatgccttcgatggcggccagtttcatcggctgatcattgacgatgaacttgccttggaggtcgccgtaaaacaccacgcagcaagcgccaatcagaccgatgacggcacccacgcgcagggagcgggtgaacagatcaaccttggcggccttgacgccgtctacctcgacagcggcgacatccttcttgttcttgacgtgcatgcgcagcaggctccaggccgagcagcccatgacgacgaaagcgccggtgcagacagcggcgaagaagacgtgcgggaactcaacccacagctgcgggttgcgcagcaggtcggcgaagctggtcaagcgcacgtggccggtctccttgttgatctcaaaggcgacggggtgctgcatgaaggagttggcggtgagaatccagatggcggagatgatggagcccgcattggtcagccacatgaagaccatatgccagacgggcttgaaccgatcccaagtgaacatccacacgccgatgaaggtcgattcgaggaagaaagccacaagcgcctcgatggccagaggggctccgaaaatatcgcccatgaagcgggagtagttcgaccaattcatgccgaactggaactcctggatgatacctgtgacaaccccgacggcgaaggagagcaggaaaaccttgccccagaacttcgtcatcgtcttatacacttccttcttggtcaccacgtacatggtttccatgatggccacggccaggcctacaccgatggtcatcggcacgaagaagaagtggtatacggttgtcatcgcgaactgaagtcgcgataacgtcaacacactcatttccttccttcccttctctgtaatacttcggaagaattgtcaggggcagcaagtgggctgtcagttgtttcctaatactgttttcacgtcggcaacctcaagcactgagcggtcgttgaccatcttcttaacgatgccaacaatccaacccttgagcttccagtgtcccatgaaatcgatctgggccacgccgaccttggggcccagggagcataccgtgcccacgctcttgaaggagaacttgccggtaggtcgcccggtcagctcggcgaccacattcgcggccgcgcagtcggcttgggcgatcgagacctgggcggtggtcggatagggccgaccactggaggggtccaacaccgcgctgacatcaccgatcaggaattccctgggattgccctccacgctcaggtcgtcttggacgaccacgcgattgcgcttgcttgagtaaccggaagcgggaatcacgctgctgcccttgacgccagtagcccaaatgatggtattggcggagaaggtggcgtcattgctgaccacctgtccggggcgaatggcggtaatgggcgtggaagtgtggaagacgacgccgtgccggcgcagatagtcagtggcccagtcggccagcttgcgatcgaacatgggcaggatcttgtcagcggcctcgatgcagccgatcttgaccttctccatggggaagtcgtagcgcttggccaactccggcagtcggtagacgagctcgcccaagtactcgatgctggtgaatccggccccgcacaccaggatgctcaggtccaggtcgtcaccgctggtgcggtaacgggccagggtctcctccaggtgacggcgggcggccaaggccgtgtccacgtcgaccagaggcaggctgttctcctcaacgccttcgatgccgaagctttcggactcgaatccgagcgcattgagcaagtagtcataggcgatgggcggatgggacttgaggaagacctggtggccttccctgtccacgcgctccacttcgtcaatcaccacgttcaccttcttggggaccgccgtcgccatggggaagcagatgtcggcctcctccttagtgccagcggccagctggtgcagttgggtggactggtagtggtagggatgcttgttcaccagtacgatgcgcgctgggactttggcatgagcgagtttcctcgcagcgcgcaaacctgcgtacccgccacccaacacggcaatcgttgtcataagttcctacctttgcttgcgcttcgctgtcgcagcattcgggcgtactcctaccgggaccaacgcctcggcagaggcagcccggccgctgtagatatgactccagtatataagaaagtaaaggttttgaacaatgctgagggcgcgaaacccgcaaaatgcgagtattttgtagtgaacaccacatttccccttgggccgccagcgcagaagcgcccgcgcagcctgtgcccccaaggaagaacggagacgttcccgctccctgctgggtgcaccaacgcctgggcgaaagggcttagtacacaaaaagctggcccgttttcacggaaccagctgcgtatcgcgcttatgcgcttcatggctggggtacctggactcgaaccaagaatggatgaaccagaatcacctgtgttgccaattacaccataccccaatggactcgcggcaactgcttgcagcaatcgccaccagaccgtcgtacccccgaccggatttggaccggtgttggcgccgtgagagggcgtagtcctagaccgctagacgacgggggcttacctatccgccgcgccatgacccggttcaatgggccacgaacacaacgagtagaagtatatgttacccgagattctggcgcaagttattcagccttcggagtgtcgtatccttaccgataatctccagagactcgaacaacggcggggacacccggcgcccggagacggctacgcgcacaggaccaaaggccaagcccggcttatagcctgcctcgtccaccagggccttggtcaggagctcgtgcaggtgctctgccgaccagtcagcctcagcaaccggtgtcagcgcacgaacggccagctccaggacctgtccagccgaatccttgagttgcttgcgggcatcgggggctggctcgatatagccctcttgacgcagcaaggagccgaccatgccggaaacctcacccagcagccgcacgcgcggctggaccagcggcgccgcagccgtcagaaccgtgcgttcccgctcggtcaaagcatcccacgaatcggcggaaatcacgccgtcacgcttgagatacggaagggagcggttcaggaagtcctgtgaatccaacatacggatatgctccgcgttgatcgccgtggccttatcgatgtcgaaatgggccggattcgccttgacgtcgcggatgtcgaagtgctcgaccagctcgtccatggagaagacatcccggtcaggagcgatggaccaacccaggagagccaggtagttaagcaggccctcgcggatgaagccgtgctcacggtggaggaagagattggactcggggtcccgcttggacagcttcttcttcccctggcccatcacatacggcatatgaccgaacaggggcgtgccctcggcgatgcccagctcggtcaggtaacggtagagcaccagctggcgtggggtggacgacagcaagtcctctccgcgcaggaccacattaatccgcatcaacgcatcgtccgtcgggttggtcagggtgtaaagaggatcgccattggggcgcacaatcacatagtcgggcaccgaacccgccttgaactcgatccgcccgcgaatcagatcgtcgaaggccaggtcctcgtcgggcatcctgatgcgcaaggcgggcttgcggccctcggccttgaaggcggccttctgctcttgcgtcagatcacggtcgaaaccatcgtagccgaatgccttggggcggcctgcggccaagttgcgggcctcgatctcctcagccgtggaatatgactcgtacgcatacccagcctcaaggagtttgccggcgacatccctgtagatgtcgccgcgctcggactggcggtagggggcgtacgggccgcccacctccacgccctcgtcccaatccaggcccagccaacgcatggcatccaggatctgctcatagctctcctcggaatcacgggcggcatcggtgtcctcgatgcggaagaccagggaaccgtgagagtggcgggcctgcgcccagttgaacagcgccgtgcggaccatgccaacgtgcggggtaccggtaggcgaagggcagaacctgacgcgcaggtccttgggcaattcaggcttaacgttcttgtcgtgctcttgactcataggaaccattgtgccccggcaacccgacgttggccggccgctggccgggaccagccaagcgcccgctcagcccctggcctgctcctgctgtctgtccttgctgtagtgctcggggatgaaacgggtctggtcatgaagcttgggccagatgacgacctcgccggcccgaagcgagcgcggcacgtcgatgatgcgctggttcgaggagccccggaattgcaggagggagttcttcttcgtgtcgatataacggccgtcgaccaacacgtccacgtacgacaggagctccgccttgtcgggggtctccccagggcgcatgagctcctcccaggtgtatccggtccagcaccagatgtctttgccatggccgaactcctgccgcacccgccgcgccagcctgagcagcataggagtgttgagcaggggctcaccacccaggaacgtgacgccttgaacgtaggaaggggccaggtctcggatgatgcggtcctccaactcatccgtgtaaggccgccccgcctgaaagtcccagatggaagcgttgtagcagttctcgcagcggaaggggcagccggagacatagatggagcagcggatgccctcgccatcggtcatgacgagaggcttgtaatcagctacgatgcccctgctgagcttgcggccatcccactgccccgccttgggattgttggtcagttcgctgggcacgcttgggccacgatcgttctcgtccggggcgaaatcccggtgagagttcttcgccgggtccttggtggcggtgaaaccttcggacatcatcacattctcctctcccccgcccgccccgcgccagcgggcccacaccaggcaaggcaatcgcgggccgccgtccctggctgcacccgcgatcccttactgccttgattattcttgaagcgccgaccactcactcctcgacgttgtcgaaccactccttggtggaaccgtccttgagcaccacatggccggtctgcccttccatgtgcttgaccctatgggcgatctcctcgtgacggccgtggaccataggcctctggatcggattgcccaggtagccgcaggtgcgcttggtcacgtttgacttctccgggtcgtcattgccgcattcggggcatttgaaaccctcttcggtgggttcgaagtcaccctcgtagccgcaggcgaagcagtggtcgatgggcgtattggtgcccaagtagccgatgccgatgtcgtatgcgtagtcccaaaccgcctcaagggccttcgggttgggctggagggaggggaactcgcagtagttgatgaatccgcccgaagccaggtaggggaagtcgcgctcgtaggagagcttctccataggggtgggacgcaaccagaccgggtagtggaaggagttggtgtagaagtcgtggtcggtgacgccctcaaccttgccgaacttctcctgatccagccggcagaagcggtcggtcagggactcggccggcgtggagtagacggagtagtggtagcgctcggccttctcccactgcttgcacagttggttcatccgccgcacgatggaaagggcgaactccttgccttccgggtcccaggagtggtcctgcatccaatccttgccatagaagaccgccgtcgcctcgtacaggccgatgtagcccagcgaaatcgtggcgcgtgaatcgcggaagagggtatcgaccgagtcggtgggcttcaaacggccgaaggcaccgtactggtagagggtgggcgcgttgatgggagtggcttgcttgcaacgcatgatgcggaactgcagggcgtggtgggccacctccatacgctggtcgaagagcttccagaaacggtccttgtcgccgcgcgattccagggcgatgcgcgggatgttgacggtgacgacgcccaggttcatgcgaccgtcctcctcatcctcgccggtctcggggttgacccagccctggaggaaggaacggcagcccataggggccttgaaggaaccggtgatcttgatcaggttctcgtagaagacgacatccgggtacatgcgcttggtggagcattcgagcgcgagctgcttcatgtcgtagttgggatcgccctcatccgcgttcaggccgtgcttgatcgtgaagaccagcttcgggaagatggcggtatggcggtccttgcccagaccacggatgcggataaggaagatggcgcgctggatctccctggcgaaccaggaagtgcccaagccgaagcctaccgtgacgaacggggtctgaccgttggagacgcggttggagttgatctggtactccatggtctgcatggcgtcgtagatgttcttgcgggtcaggatcttcgcatagacctggcgagcgcgcacaatggccggcgcatccaggtcgaagggggcgtcctcgccgattggggggcggtcgtccatgtgaatccagtcggattcgcgggccttgaggccgcggaccacctcccgggccagttcaatgggctcctcgtccggcaggacggcttcggccatcttgtaattcttctcgtagtccagcttggcgtaccgttccagcatttcatcggcgcggttgacggtctggccgccgtactgggaaccggcgatgtccttgatgatctgcgtgatctgcgtggccgccgtgccgatggacttgggggaatccatcatcgcgttgcccagctcgaagccgttggccagcatgtccccgaaattaggcagggagcagttggtctcggcggtgaacggcgagtagtcggcgtcatggaagtggatgtcacccttcaggtgggcgttggccacgtccttgggcagcatcttcagggccgaggccttggagaccgcgccggccagcaggtcgcgctgggtggcgtagacgttggcgtccttgttggcgttctcccgcaccagcgactcgtccttcgaggtgagcctgtggacggcctcattcacatcggtggccttggcccgttcgatgtcgcggctcaggcgataggaggtgtaggctcgggcgatgtcgtagtagtgggcgttgaccagggcgtgctcgaccagagtctggatatcctcaatcttgaccgggttggtgtagcggtcgcgaatctccgactcgaccgacagggtcatggagcggatcgcctgcttgaccttggggtcgatttgagtgttgacatccttgaatgccgcctcgacggcgtgcatgatgttgatggggtcgaaatcgacgatgcggccgtcccgcttctccaccaggatgccatcaacggcgttggacgtccccaggaccttgctcccctgcgtccgatccgtcatcacctgcgtatccataatcctcgcccttccaagccgcgctgagacacccgcgcttactcacaaaccacatctgcgtcatttcccgcagcatccccagcctagcacggaaaagcacaatatctagtgaaaaacgaaaaaaccatcactatatctagtttctcatggaattacgggagcaagctcacagcttatggctacgctcagacagagcccggaagcgcaagatggcgcacgtaccgagccggcaccccgacagcctccgaacccgacacgcgcacccgacaccgccctcatcctcgcacccccaccaagaccaaccgggggggggggcaacacacgcaccgagccggagccccacccgaaagagcgggacaccggctcggctatagcaaatcggacctcaggcggccgcgcgcggccgccggcggacccggaatcagaactcagtcaccatgccatcgtaagaggagatgaagccctccttgacggcggcggcttgcatctgctcataggtagccagaccgttgtgggagaagtggttggctacgaaaatcgtgctatcgtcagccagccccatttcgaccatgcggtcccggaccttgagattgtcggcgaagttcatatgcacatcggacttgatgggttccagggcgtgcgtgcagtcaagcgaaacatagtcgtacttgaggccggcgtcctccatgtccttccatgccgactcatagaagggggcggtgtcatgggcgtagagcagggccttctcgccatcggtgatgccgtagaagaggcagtccccaaagtggtggccgtgcttggcctcgaaagcgtggaccgtgtactccttaccgttggacgccgtcaccgtgaccgcatcgccagggtgcaggctgtgataggtcagcctggagtagtcgtagtgctcctccaggaagaaggcgcgctcatagaagcccttcaccgtctccgagccatacacatccatatgggtggggttgtcattggcataccaatccatcctgtaagccaagtcctcgccgtagaagtggtcggagtgccagtgggtgatgaagagggtggtgatgctaggcagatcgaagtgctcatccacgaagtggtggtaagtgtcccccgggaaatccagaagaagggaatcgtccaccaaggcctgggactgggtgcgaatctccttgccgcccacctcactggcgtgcttgcacaggtcgcacatgcagaagataccgggaatgcgttcggccgccgcggttccaagatgttgcaatttcataattgaactccttttctcactttcaggaaaactggctgggaaggaaagggaggggcttccacaccctcccttatgccctcagacctcgatgcctgcggcctcttccaggcgccgttgcttcatgatcaccctgttgccgaaggtgcatgccacgattccgaccaggctgaaagcagccagcatgatgaagatgatcttgtaagcggtgcgggtgtcaaaagcatcaatgatggcaccgaacagggggtaagcgaagaacgaggggcagtagccgatgaaggaagcgatcgacatggccgtggcggaaatgtcggagtccacgccgctttcaccgattggcgcatagtagacagccctgagcgccacgcaaatgaatgtgacagcgcagcagagcaccacgactggcaacatccagctcgacgtacgtggggtcatgacgatgcacacgcagatgacggcaacgatgacgtagagcagggtcatccactggggggtggtcttaaagcgcttggtggccagaacgccagacagggccgcggcgattagaccgaccagacccgagttgacggtgccgaacaggccggcggccgcatcggaaaggtggaaggagttctggacgaagggcaggaagtaggtgttggccgcaacgtagatcaggtaggtggccgccgcgccgaaaccggtggtccagacgatcggcagcttcatggccttaagcaccatggacacgccgttacgatcctgcttgtggtccttctcatccttctgatcgtgcatgaagtccttgggaatgaacttcagcaccacgaacgagtacagcatcatgaaaatcgggtagatggtcatggagagccgggcgccgaagaggttggaaccgccgacggtgaagaggaagagggtgaaccaggtgatgatcagccccatgccggaacggatggcttcctggacgctgaaggcagcggcctgcgttttctctgtggccaggcccttggtcgacttctgaatggtgggccaataaattgcgtcaccgaagaaaccataggcggcgaaggccactaccaggaaccagtagggaagattggggaccaggcccaggatgagggcgaaaatgccgtagccccacaggtcgacggcgatcagcttgcggatgggcaacaagtcctggagccagcccaggagcgcgtatccgaagatctgcacgaaaccgatcaacccgagcaggaagcctagttgcgcgttcgagacgcccaaggcgtgcctgaagggttcgtatataacgcttttaatactggaccaccagtaaatggaagtggaaaacgtaatgaccaagaacagaccgaatcgatgtttatccatccccaggtagttcaacagcactctcatggcaccgcaccatcctcttcgataggaactcttctccgcaacagcgacattgcttcgccaccacgagtgaatatgacaattccgagataaatcatcgtaaggccaacgaaaacatctcactgaggcatgaaatcagtctaacctcctcacgtttggtttacaaaccgataatttcacatgatgcaccggttcgagacccaagccgccgaaacagctaggcccaaacaagcgcccaggcactggcgcacctggcttggaaggtcctgcccaatcccctgtccgatccacacccctatgtccctgaacagccacgacttcccggcgagtctcgcagggagcgacccttggacgcgcctatctcctgccttgaacctatactggatgcagcttcgcgcggttggtggcagcagccgcgtgccccaaggattcaggcaggcgagcgtcccatcagcgggccgcccgccggcgattcggcaactcgcgcgggctcctcaccttcccgaccagcgacccggaatcgcgtacacgcgctgcaagcgcgaaaggcaaggtgatgggccaatgaggatgagcacacgcaaacgcaccggggccaaggccggaggacggaccggccttctgcagtcgcgacggccaggcagggcagtggccgtgatctgttccttggccctggccgtcggcgcgctggccggttgcggcgccggcgccaaggcccaagacggcgaagacatctcattcatgctggactggacgcccaataccaaccatgtaggcatctacacggcccagcgtcaggggtattacaagcaagccggagtctcagtcaaaatcctcccgaccgcccaggccggcgccgagacctcggtcgaaaacggtgtggccgacgtgggcttctcgaagctaagcaatttggccgctttcaacgcccagggcgcggatctcaggcaggtgttcgacatcgggcaaaaacccataggccgctggtgctccctggcctcgcgcaccgacatcaagacccctaaggacttcgacgggaagaccttcgtcagcttcggatcggccgagcagaccgcggtcgtcaagcagatgatcaagaacgccggtggccaaggagacttccagcgggccacttccggcacctccaccttcgccaccctgacctccggcaaaggagacttcgccggtttctacgtgacctgggagggggtgcaagccgacttgaaaggccccaagctccactgcttcgtccagtccgactggggggtgcccggcaatccggaccagatcggcttcgtagtctcctccaactggctgaagcaggaaagccaccgccaggccctgcgccggttcgttcaagccagcaagcgaggctacgactgggccctggcccacccggaccaggccgccgacatcttggtcgagcaagcccccgccgcccggatcgacccccagcaggcgcgcgcatcgatggagcgaatcgtcaaggaaggctactggacaggccagcctggagccacgactcttcctggaacggtggatatggggcaggcccagacctacctggacttccagcagacggccggctcctaccaagacggcaagggcggcaagctcaagcgagcgccgcaggccaaggacctctggaccgacgagttcgtcaagtgaaaacacaaccaacgcaacgacctcgcgccgcccaggccgctggactccaatccaggcccaggccgacgcggacaggcggcagcccgcgcggcgtctggcgtaggctcctgccccctatgctggtcttcgcggccctcatcgcagcctggcaggcctggaccgacctcggttccatctcggagcacgcgctgccctcccccagccgcatcatccaggccagcctggccgcctggccggacctgatggaggcgacccagcccactgcgaccgaaggattcatcggcttcctactggccaccgggctaggggtgctggccggcatcggcctctaccgttggcgcagcgtccacgacgccctctacccgctgatcgccgccgcccagatggtgccgttgatcaccgtcgccccgctgttcatcatctggttcggcttcgagcctctgggcaaagtggtcatcgtcgcgctcttcgccctcttccccatcgccgtccagacgtatcggggcttgcaagaggtccctcccttctatcaggacgtggccctgacctgcggggccagccaggcctggaccctgtggcacgtgaagctgcgcgtagccgcccggcagattttctccggcctgcgcgtctccgccgcctacgtcttcgccacagcggcgaccgctgaatacctgggcgccaggaacggcttgggcatctggctccagtccgctttcaactccttccaaacgccgctgatcttctccgccaccctggtcatcatggccttgaccggaatcctcctcgggctgatcgccttggccgagcgggcgctgatcggcggggatgaccaggccgactccgccaggcccgaggactgaccggacccgtccgcgggccctccggcatgcaagccgggcgacgctgacaaccgcggtcgaatctgccatactggtaggtgtggaaaccgtccggcgcgaatgctggcgcagaagactcggggggacggcttgaacagccgcttaggcaagggagttacagatgacgcagtggaatgaccagacccaaggagcgaacggggacccccaggcagggaccccacagccaatcgcggaccaaccgggcgctggccagagcccggacgggcaagcccccgggaccaaccaagcggccaaccagcagccttacgggggcgcgcaggcctacccctaccaactgtatgggacaggtgaggagcagccattctacgtccagcaacccgcgtacgtgcgacagcagccatacagccagcccgaatacggccaacagtcggcttacggggagcaggccagcccgacaggccagccaagtcagcccccatacggatacgggcagcaaagccagccctcgtacgggcagcccgccgccagccagccaggagcgcaaggacccttctacggtcaggctccagactatgggcaaggaccagactacggacagccctacggccagcaacccagcgggccctacatgggggaccagccctccctgccgcagaccacgccgatgtacacggtcccgctgggaaccggcggtgagccgcccctcaaccagccctggtacggcatcagcttcggagccgccattaagcgcttcttcagcaagtacgccgacttctccggccgcgcctcccggggcgagttctggtggtccttcctcttcctgctgcttgtgggcctgggcctgggcatcgtgaccgggcagatgggccgcttcggcagctatataagctacatatgggacttggccgtcctagtgcccaacatatcgattgccgtacgcaggctgcatgacagcaatctttccggtttgtggattctcctgcccttcggcttgacttacggcagcatcatcgccatggccgtcaccatctcccacatcggccttgacgccttcctctccgcggacgccacggcgatcacccccgcctcggtcaaagcgctgagctgggaattcttcatcatgatggccggcttcatcgtctggctggtcttcacagtccgtcagtccgacccacatggcgcccgcttcgacaagaccgcgtgattccgccctaatcgagggagtcgatgccgcagccatgtaaacgcgagcccggaccctgcgcgcagcaggatccgggctcattttgcagcaatcagcgccgagcgctcacagctccaccggcggtttgtgcgggtcctccggcacgtgcgcgaacttggccttcagggcttcgcggctcttgcgctcatcctcttccttggcctggcgcttagcctcgtccgggtcccagagcaggtcgtcacggtggccgtcccactcagcctggaccaggggcgcggcctgttcagccaggctctggagcgaatcctgacccagcaagtggaccagctgctcgtccgagacgtagaagcggggaatctcaaaacgctcattgagctcattggcgaacaggaggaccggcaaggccctggccggttcgtccgagcccgcgcccaccgcatgcgccaggtcccacgcggccagcatcgacgcagccaggcgttgggcgatgacctgcggatcggcgctagcctcgaccgtctggccttccgggctcatggcctggagtacggcctgggccacatcagccccggcctgggatttttgatcactccaaccggcggccatgaggtcggcggccgcccgcacctggctgaagtcgccggactgggcgtatcccgccatgccatcgcaagcgtcttccgcggccaaaagcgcatccacgatcgactgcgggcggccagggatctggtccgcgccctcatagacaaactcggcatcaggaatcgtcacatcctcgccggtcatgatgcgcgcgaaggtctgcgtcatcctgacctgcaggttctccccatacttggcgtcattgtccagctgcgtcgcgtcgttcaaaggccacagcccaatcaagtgcgcgcccgcgtcagccgccttccccaactgcggcagcgctgccagcccgtccactcgatcaccgtcaaatgcgtatgtcatctgccctcctcggcttatgcaacccacagcccacgcggttccccaccagggcgcgcgagcccactgccatcatatgctatgggccggttcaagccagccgcgcagccgggtccgcatatgtgatgccgagcacgcttccactgccggactcgaaggtgaccgaagtgacagaagccagggccgtccggcgcaaaagcatgttgtgctcggggcgcccggtctccagcatgtggcggaagctccagatgggtgattcgtggctgacaacgatgatctgctcgccgggcctgtgctccaactgctcgcgcacgaagtcgctgacacgaccggcgattgactggtaggactcgccccaggagggccgcatcaggttggtcaggagccgccagttgccgtcccgccacaaggcgccgtccccacggccgattctcttgcccctgaactcgttgcccgcttcaatcaaacggccgtcctcgatgaggtccaaggggcgctcccctcgctcacgacggcccagattgatctggtcgcgtatgatgccagcggtctcctgagcgcgttccaggggcgaggtgtacaaggcggacacgctctgggtggcggggttcaaggccaggaagcgagctgtcgcggcggccatcctcgccccgcgttgggacaaatgatagcctggcagacgctcgtagagcacgtgattagggttgtaaacctttccgtggcggacgaaatgaatggtggtcgctggcaaaattgtgcctcctgccgccggaagccgcccgatagcaaggctggcccagcgcgtcgtcatcagtgtcaactaaagtttgacatggatcgtctacggccacaagtcacgccgattcgcgcccgtcccccccctccccccctccatgattgcccgccctggcgcggcgacgaaaggatcccctatgcccagccaagtcaccgcagccgtcagagaggtggggcgccgcattctaggtggctactccgagctactgaggatgcccggcaccgcccggttcgccatcggcgccgttgtcgcctccatgcctttccctatggtgggcatgaccatcacgatttcggtccagcgttactacggctcctacaccttggccggctccctgaccgccatccaagcgatttctctagcggtcatgagcccgttgctgggtaagctggtcgacaagttcggccagaggcaggtctccatcccgaccattggggtctggatggtggcggcggccagtctgacgacggccatcagctcccacgccccgatttgggccctatactgcatcacccccttcatggcggccatcccaccttggggtgccatgagccggcagcgctggaccctcttgctcaagggcgaccatgtgcgcaccgagcgggccctatccctgtgcggtgtcttagatgaagccatgtgggtggtcggcaaccccctggcctcgatcctggctgtcatctcaggtatcctggccttctccttcactggcgtgtgcgtagccgtcggcgccctgatgttcctgaccgagctgtccaccgaaccgccttcccagacggtcctggcccgccgcgatggggtcagccgcaaggtctaccgggcccgccaggccagaatccaggcccaattgcaaggcgaagaaggctccagcgctttctggagctccggactggtcgccgtttgcatcacctggttcggcttaggcgccttccagtccgccgcttcgatctcgatcatctccttcgccagcgagcagggagccaagcagatgactggcttcatcttcgcctgcttctccttctcctccctgatcggcgccctcatgtacggggcgaagagctggacgattcccctgtggaagcgcttttacttctgcctcctcgtcgtgaacctgggcatagcctcgttcatgttcgcccgcaacatatggacgatcatggccatctacctggtcatcggagtctgccaggcccctacttggatcaacggcaaccagctcatgctccacctggtgccgcccttccgcttcaccgagggcatggcttggctgaacgccatgaactcaatcggatcgtccgcaggctcggcgatcgccggggtcttcatcgaccgttacgggtcccagggcggattcagtgtggtcaccttcctggccttgaccagcctggccatcgccttcatcggtttcaagcagatccgcggctccacccagcgcccggacctaaccgtcatacccgtctgaacgcgcggcgccgggcctcccaacggtttctcgccccccgccttccgcacgaccgttcatgagccctcggatataagtaccgcacggaaaagccgccgatcccacttcggacagggccatgctgtaggatttcactgtgcggaaattaattgaacaggtggccaagttcggcgtcgtaggtattatcgcttttctgattgacatcggagtgatgaacatcctcctccacctccacctgaacaacttgctggcttccacggcctccttcctgatttcgctggccttcaactacctggcgagcatgaagtacgtcttcacccaccgcgacgacatggcccgctggatggagatcgtggtcttcttcgtctccgctgccataggcctggggattaacgaagtcatcatctgggcgggcacctccatgctcccagccgatgccgccgtcagcatgcacgccaagtatgtgctctacaccaacgccagcaagatcgtatccacggttgtcgtcgccatctggaatttcatcatccgcaagtggctcctggacgcccctgcgccgggcaagcccaagaacgagcgctcgttcgcccgtcggctgggtgcattctccctagcgcaccgccccttcggctggcagtgattccggacgctggtctactctggagatggcggttcggttgggggccagcgcgcttgagcaccgctgcccaaccggcacatccacaggaaggattccactatgccagtcatccatacccatgtttccacccctttgagcgcagaacagcgcgaacggatcaagaccgcttacggccaggccatcaccgcggtgcccggtaagtccgaaggctggctgatgtgcccgttcgagtcggacatgcccatctacttcgccggcgatgattccaagcccgccgcatacgtagaggtcaacgtcttcggctccgacgtgccgcgctcagcctgggagcagctcacccagtcgatcatgaaagccctgaacgaggagctgggcatccccaacgaccgcacctacatccgctacacggctacgaccgactggggatggaacggttccaacttctaaccttaggaagaacgcgagaaaggctcccgatcccctgcgcaggggttcgggagcctttcttctgcttaccctgcgcgcccatcagggccggcgcgggctagcgatcacttgtcgccggtcaccttgacggtgaaggaggcgctgatctccgggtggagggccaccttggccgggaattcgcccggcgtcttgattggttcgaccgagatggagcgaggctcgaccggagccttgtcggccagggccttggcaatcgcgtcggccgagatggagccgaaaagcttaccggactcggagaccttggcgtgcatctcaacgacagtgccttcgatcgcgctcttcgctgcgacggcatcctcgcgggtggccaggagcttggcctggcgggcgcggcgcatggactcgatctgtgtggcggcgcccttggtccaggcgaaggccaggcccttggggatcaggaagttgcgggcgtaaccgggcttcacgtcgactacgtcgccggagttacccaggtcgccaacggtgctggtcaggatgaccttgcttgtctttgccattgtcgttcctccctcagcggccggtggtctggtaaggcaggagagccatctcgcgggcgttcttgatcgccttggagagctggcgctgctgctggacggtgacgcccgtgatccgacgggaacgaatcttgccccggtcagagatgaacttgcgaagcagagcgacatccttgtaatcgatctcgtgaaccttggctacgctcagcggattcggcttcttcttgattggcttgaccggcgcttgcggccttttgcgtgacatatgcactccttaaacaacacactacgaataattaactgatgaaagctggcccttgggaaaggccagctgcatccacactgggcccagggccgctcagaattccggctcatccccggatccgccgaaatcgtcggaggaaccgaaggacccgtaagagccgccagccgcatccgaaccgccagaggacggcgtggaccagggatcctgggccggcgcctgctgtcgagctgaggggttgccgccctggggggcctgccgaccaccggccggcgccgaagcaccaccctggtagccgccttggtagcctccgccttgctgcgagccagcgaaaccgccgcgcccgccgccggcaccgccgccgctacccgagtttcgggtcacctgagcggtgttgcgggtcagagcgggaccgatctcgtccacgcgcatctccacgaccgtgcggttgttgccttctcggtcctggtaggaacgctggaccaaccggccctgggcgatgactcgcatgcccttggcgaggctggcctgcacgttggaggccatcggcgcataggtggaatcccaggccgagcagcgcaggaagagggcgtcgccgtcctcccactgccccgagttgcggttgtactgccgcggggtggaggcgatcgtgaaatcagcgaccgtgccgccattggcggtggtgcgtacctccgggtcggcggtgaggttacccaccaccgtgatgatcgtgtcccctgccatggttcctgcctttcctagcggatctgcggcggggctctatgacctcgcccagccctgcgcctggcttacttggcgtccttgcgaaggatcttggtgcgaatgatggattcgctcaggttcagcacacggtcgagctcgtcggagacggccggctcgcacgtgtagttgatcaccgcgtagttgccctcggtattgccgtcaatctcgtaggccagcttacggcgaccccagaaatcggtcttatcgatggaaccgccctctttagtgacgatctcgagatactgctgagccatcttctccagggctcgctcgtcgagggacggatcagcgatgaacatcagttcatacttgtgcgcagacatcacccacctcctttggacatactcggtcgcggactctccgcgacaggagggtgtagcactgttgcccgcatgtcagagccggcatcgggccgcctactaaatgcggaatcaaacccttacattacactgacaggcagacttgggagaaggcattccgcaagtcagcggttccgaatgcggtgtccacacagcctgctggcagcccgccattcagcacccaccctactttttgcgtcagtgcccttcccgctggtatttgtcctcagtctcggccttgctgggcatccaccaatcggcatggtccctataccaggcgattgtctcgtccaggcccaccgcgaagtccgcgcaccggggtcgccaacccagctggtcgcggatgccgctggcgttcagggcgtacctgcggtcagctccgggccggtcccgcacccagtcgaactcgtctacgggcctgcccatgcgctccaaaatcatgcgaagcacctggatattgctccgctcgccgtccgcgcctatcaggtaggttctcccgatttcgccgcgggtcaggacctcccaaatcgccgtgcagttatcctcgaccgcgatccagtcacggaccgccctcccatccccatagagtttgggtcgtacaccgcacaggatattggtgatctgccgggggatgaacttctccacgtgctgtcgtgggccgtagttgttggagctgttcgagatggttacccggctgccatacgtcctgtgccaggcgcgaaccagatggtcggccgccgccttggaagctgcgtacggcccggaaggacggtaggggctgcgctcggtaaagcgggaggaatcgtccagagccaggtctccgtagacctcgtcggtcgaaacctggtggaagcgcaggttgtggcgccgggccgcctcaagcaggacgtacgtacccaccacgttagtgctgatgaagggggcgggatcgcaaatggcgttgtcgttgtgggactcggcggcgaagttgacaatagcatccacaccataatccgtgattacctgctcgacttgcgcaacatcgcaaatgtcgccctcgacgatatcgagacgttcgaggtcaaccccagacaggctcttcaaattcgccgcgtaggtaaatttgtcgaaaaccacaatgtggggtaagcgatgctctcgtaatacgaatctgacaaagttggagccaatgaagccggcaccgccggtaaccagaagacatgcgaaatcgccctggcaaggttgtacgtccgaatctggcatgcttatcaccacgctacttacgaataaacgaatcgggatgcatagactgatcgctacgcctgtttggggatggactgaactgcgccgacagaaggcccagcacaatcgggaacaggaagatggtatagaacatgtaccgcagaggcccagagtacccaggtgtagaaagactgaccggatacaacaggactatgtacggaagccagcagcagcaaattcggccagcgtcaggcaatacaccccgaagattttgagcatgcgagaacgtcatcagcttgtgcgtcctgcgcaacttcgggctcaagcgtaggctcggaaacagaggtggatgattcagcctgacgagagcatcggccagcatgaaaacgagggagaacaacagggcatagcagagaatatccaggtaaaatgcggcttccctgacagggatgcgccctttcacggccgcattgctgctgcatgcaaagagaaccccaagcacgacgggaatcgcgacggcatcaaacatacccttatcgcggtcatcgccgctgtcaagtacaaccacactctgagcttgcattattgcccttggtctagagcgccatgaagcgattcatcgcatcaatcgacgcgggcgaccctatgtaatcagcggccacatgctcatgcgtgtgcatatccgcaggaagcgacatatagtctccatatgcccgacgcaaatattcccgataatcccggggaaccggtacgtctactccccggaaggtaagcttctccggtggcatccattctccaatcgggtatggccccgaagacctgacctcgtcaatgttctcaattcctcggatcaggccggtggcaccctggctggtcggcagaacagataggcgctcgcctaaggaggcgagcctgctcgcaagcctctcctcgaggcccgccacacagggattgccttgcacgatgtacttttcttcgctccattcggagtgggcgtatgcctcccgcaactcatccacaaatgcccgacgctcggcggagcactgctcccaggcagtcttaggatcgctcgccacccaatccagggggaagaggtctataaagcaggggttgtcatcatcagcgagcctgaagcgtatctgtttacatggcacataccagtcccagagcacggtaatccggaagcggtcatcggcctcgacgagctcggccaacctatccaactggtctctgggtatgtaaatatccacatcgtcgtcccagggaatgaaatcgccgtgacggaaggcccctagaacggtgccgccggtgccccaatactgaatctcgtgatccttgcacaagtcggaaagaagagcgaacaatttagcctcggcatcctggaaaagctggtggatgccagatgccttcggcagagctcggaagaaccggatctgggtgtcctccaaggactctccttcgcgcctcatcaactgccagtacataatcagctgacgctcgcgatcaaggtctcgggcgttctcctcacggtccaggctttcctggagccggagcatctgcgcgctcatatcatccaactggcgccgcagggaagcattgtcctccttcagcagggcgaactgcccggcgatgtagcgctcggcatcgtgaaatgattgcgcggatgcaggcagcaatttctcccttgcgtgttgtatgaaaccgcctatcattggcctcgcgtccttccgcctgtctctttgccgccgtaaccccgcgcgaggccaaaatacaaaccagttctttcaaaccccgttcggaaatccatgcttgccttgaaccccagccttctgatgcgcgtattatcaagtatattatcctgaatgggcgaaaaccggctacccacccgctcgctgggctgttcaaaccggaccttctgaacgccgttcccaaataaatcgacggccgttctggcgatatcggccaccgtaacgatgtcggccatggaggacacattgtaagtccggttgtcaccacgaagcagaagcagcaggatggcgaacaccgcgtcctcgatgtaacaatacgtccgccgctgccgccccgaacttagcatcatgatgtcccgcccggctttgaggtcagcgaggaaagcggtcgtgactttgggatcatcgatgctatctccggggccatacaagtatgagagccgggccacgctaacaggaaggccatactgagccacagcgccggcgcacagattctccgcggcgattttgccgaccggatagcagtcacgcacattactagggtccatgcttccatcagatccttcagtcagcggcaactgattatcatgtctgccataagcctcgacgctggaaaggtacaccattcggcgcagcgtcgatgcttgtccgcgtaaagcatcaatcacatggtacgtgccgcagacgttcgtcatcaatgtaccgacgggatcacgcgaatacgccaccggattcgcgttgctggccgcgtggacgcagaagtcgatgccgctgatagctgcttccgtgagagaatcacgcacatcgccaatcaggaaactgtcgcgctctgggtcgataaaagccccaagccgattcctggccttttcctcattgcggccgcaaagcaccaaggcgacgtcagccacgccctgctggcgcagcccagagaagaaccgaaccaagaacgaaccaacgaatccagtaacgccggtcaacaggacgcgcgagctgtcgaattgcccccaaagctgatggtgttgtccaataaggtttcccacgtcttcgaaaaggatgcgctcagcggattcaccggtccccgataggccgttcacagaacctcacccgcctccagataggcttcgaacagggcgatatcctcggagctggtgagtttgatatttaaattgtcacccaggaccgtgtggactgcatgccctgtctcaaccagcagagtgcaggtcgcgattgaatccgtgatgcccatctcgtcagcctgctggtggataagcttgaactgccctagcctcagactttgagggtctgcgtacgcaggatatgagtcctgccgaccagctcgcgcgaggactccccgttatcggtgtacagcagggtctccgttgcaggcacagccgtcacagcattcccgtatttcttgacgactgcgatattggcgttgatgacttcctcggacaggaggggacgcaccccatcatgaatcagcacgatatcctggtcatcgtagtgcccctccaaatatcggagccctcttctgatcgattgaaacccgctggagccgccaggcacaacctccaccactttggacaaacggcaatcgcggacatactcattgacgatatccacccattcaggcaaggccacgatgacgacatcgtcaacggttatggcccgttagaaggcttcaatagtgtagacaagtaccggcctgttcctcaccatcagaaactgctgaggcacaggccccttcatccgggcgcctactccgccagcgagcactagagccaccactttaccttgacgatccggcaaatcgacggatgccgatcctgggtggctccggcactagcatcagcgctgattactgttccactgaatccatgtctatataataaaagtgcaggggggggggggtggaggtaggcgaacatccgcaatttccccatcaatcatacttgactgactccgacctgtcggatacgcaatgcccggtcgctcagcagggcgtactcactattgcgggaatcccgtatagcaaatacgcatgagttctcgtcattggtaaaggcaatcatctccgtcggcgcatcaggacgttcccgacttgcggtcctcaatgaagcgaccagcctgaactctccattgttgaagaggttaagaggcatttcgaaatgcgcgatttgatggcccgactggcggagtttgatcctgtttgacccggtatcgtatacaatgccaccgcggcgggtgtcgtgcatggcaatggccaagtagaattcccggtcctcgtcatactggtactccacatcgaatcggaaaatatcgctgctgctgcacacaggcgaggaaatcggataagcccgcagcttggggacccgttcgttcagaccggtgggatacttgtcgctcttgctgtcgcgggcatccttctttgcagccttgagattctccaaagtatagcggttggcgacatcgtccttgtctcctgaaacaacgatatgcccgtcctggatcaggatcgccttgtcgcagtactttttcacagcgctcatatcgtgggtgaccaggatgacggttttgctggggtctttcttcacttgggcgaagtaatcgtcacatttgcgttggaaggcttcgtctcccacggccaacacctcatcaagcaccaggatatcgccctgagccttaatggccaccgagaaagccaacctgacctgcatgccgctggaatagttcttcagcttctgatccatgaaatcgccaagctcagcgaactcgacgatatcgtcgtacatggcatccacttcttcactagtgaatcccaacaaagcaccgttcagatagacgttctcccggccggtgagctcaggattgaaccccacgcctaactcgatgaaggggaccagcttgcctgagtaactgattttgccacgttcggggcagtatatgccggaaatgagcttcagcagggtggactttccactgccgttgcggcccactataccgaagaagtccccacggtggacctgaaaagagatgtcctccagaacctgttgctctttgtaccccttgatcccgcgggaccaattgatgaaggcctgcttaagaccggtcgcctgctcggtgggcagacggaagaccttgtcgacatgctcgacggaaagcaccactggactggaattctcagctggcgtgcttgcgcttactttacccattacatcacctcggcgaaccgacgattgtacttacggaacacagcgattcccagcacgacgacgaatatcgaaatgcacagaggaatgagccgaatccatggatttcctatctggttccagaccgtaggagtcgactcgggagcgatgaagttgtgacgaatatcctgaatcgactgagcgatggggttcagcaggagcgctttggccacgacagggccccaccaatgctggatgttagagacggcggtaagaggataaatcacaggaatcgaatagaagatggcctgctgcagcacatcccatatatgtgagatgtctctgaaatacacgtacatggtggacatcaacaaggtaaagccaatagccagcatatacagctccaaaatgttcaaaggcagcagaatcacacgccaggtgaactgcaccctgttgaacagggcgaagatgaacaccacgatcaggttgataccgaaactaatcaaggcgcccatcgcggccgaaaccaccacgatataattcgggaaatggaccttgcgcagcaaatccccacgatcaacgatggaccgcagccctatcgaagtggcctcactaaagaactgccaggaactgatgcccagcagcaaaacgacaggataggtgcgcgttccgtcggtcatccgaaggaacttcgcgaataccaggtacatcacgcaaaacagcatcaacggctgaagcacggaccaggcaaccccaagaaacgaaccctggtagcgcagcttgaaatcggtctttacaagctctttcagaacgacccacgagtaatggtatcgcttcctgactctattagctatatctgacacagagatatagtttagcaggtggtatatagctgtccgccacgcgcgtactaccgattctacaatgcgctcttccactacagccactggcaacacataaaagcgagccgccgcagacctaacacgggcgttgtgcatcgtttaaactgaagaccgtgttccaaccagttccattcaagctaattccttcatgaccactatgccaactagggtgagtagagcaaagaacacgaaagaggtgacatggcaaattcgtcgcaacggcactcagcccagaatccccgtaatatcaacatcgagctattacgcatttttgcgatggtactggtcgtgctttgccatgccgtcatacatttggacgttggcaattcacagtttcgaatggaattggccgtggtaccaggatggaagaacgcgatacgcttcacggccgtccagtacgggcaagtaggcgtctcgattttctttatgatttcaggcttcttcctgagcagcaagacgttctcctggcgaagggtgttcctcacctggtcccaggcgtttctgtacacgacactctgcttcttctccatcctcatataccagcgtttttctccgctcccggctttcctggcaccattgatgcaaggaagtgagcttaagagaaccgctttgtggagcttcttccccttcctgtacgacagctactggttcattgatgcctacatcgtcatgctcctattcgtgccatttatcaatttggtcatgcggtactccacaaaacgacagctaatagctctcatagcattgctggcttttttgggcacgtggcccttgttcttcaaccaaacaaaccactggaataacgtgacctatgcgataatctgctacctgatcggcggtttcatacatcaagagctgtcaagggtcagggaaactcgccctctggtcctcagcgcgctgattgcgacgtcgaccatagccatgactctgttcaattacatcgccgcttctcggtcctcagtaatcactgcgctgggctggcctgccctagtgaaacagggtcttcaagttctgccaatcctcatagcctcctgcctgctgattgccgctttgaagatggcgcccagatcgaaagagaccactgcgaacacagtgatccgtgcagtggcgaagagcaccttcggcgtatatctcctgcatgagaacatctttggtttcagaatcctgtggacagcagtagcccgtttcatgcctcatccgtccggattgattgaatcggcgattcttctcatcatcatcgtaatcgcagttttccttcttctcgatggaatggccttcctcttagattccctcctcattcatccctgtcagaagttggcttttgctgcaatcgaccgccataaagcgcttactcatcaagagtagcggacaccacctggtcatcggcgatacttgtattccgactctcttctcggatgaagggcactgctatcatcaaagcaaagcagaacaagaaaccgagcgagtaccgcacctgatgcgcaggcagtgccaacaagttcagccaagtgaatacgaagggtaaagtgaacagcagtttgccgtattctctcctaatgacgacaaaacccatcgccaccaaaggaatccaaagcacatatacagcttcgctgccaagaagagaaaaaggcggaatcttgttcagcaatgacaccaagggtacagctatggtcttttgcccatgcgatagcgcacactcctcataccctgggaacaatgaacgaccaccagcctcccaccaaccgcaacgcacagctgacgtgtaatagtaagtatcgtgtaccacgaacggaattgccaagtataaggcagccttgaaatactctccaggatatctaaaaaagaggcgcgcccaaatcgccatgaactttgtacgatccaattttgtggcatcctgccgataggcatagtgcttaacataatcggaactgttgcgattccaatgttgatgagcttcttttacgtctattaccttttcaattgcctttttgtcctttggtgacaattccggccatttatcaatagctacctttgcgacctgctgcataggaacagagatggcttcttgaggacctcctggagcaattcttaatggagaaaatagtgtagccggtatcacaatggccacgagtatcggtggaagtagagccataagagcaacacgcactctatttttatgagcaaagagggcaagtgccaacagtgacagacctgtgacatatactgatgttttcttagtcaaaccgcccacgataccaaaaactaccactgcagtaataagagaaatggtcaaccgttcgtgcttgcgcacccgatagacgcactcataaaacagcacacaccaaagtacaaaaaatggcagccatgtcgtatctttgagaacaatactcatatacattgggaatgcgggcaacaaagcgctgaaaaacaggatggcaacaacagctccgtccggaagactggttctcctcctaatccaagcaagagccacggccaaagagaaagcagcgaataaggactggcagatgataagcacccgcattcctgcaatctcattaccaaggaaaacgcccaactggtcaaagagtccgtacaacaaagtgtcaaatactggatgatgatcctgagccctgtatcccggcaactcattcatcagcataggatcccagacatggccagttttatactgaattagttgaaccatggcgtcaacaccaattattgccggtccattaatgataagtacaggcatccaacatacgaagataatgatcgtagttatcaatatatgttttggcgtgaaatcaataaagctagccaatatgcgccaaatcttgtgagatacagacttcgggtctgcgacattctgcagctcctgctcgctgacctccattttagatcgatccatatacttagcggcgatgtcttccaaccagcacagtatcgcaaagacaaacatggacagagcaagaacctggagagcaaggcaaagtatgaaacttgtagaactccgcatagcttgctcgtgggtttgcgcctgaatcgaacctctttccaggctagggtcaggggccattcgcggcaaaatggtagaggaagcgatagcagcggatagtatgcagttaacaaccttgacccgaatggtcgcaacactcaacagcggatagatgcgatacacaatgtatccgataccggtcatcatggaaaaagaacctacagcaccaagcacgcccacagcgtccatactttggctgaagaaactagagctatttgaaaaagcggccgagctcgtactccttagggtcaaagccatagttgacagaatcccgactataattgagctggtatagcgtcttatcggcacccttttcatctttcaacatccattccgcatcacgcgcataaggttaaaatgagtttgtcaggaagaaatcaggcgccctgactgtgggtagtcaatttggggattgaaccggaaggcctccagcatcttgccgtacatctgccggcgcagtttcttctccacatgtccgatgcgcatagacttgaacaccatgccacagaagagcaagtagcgcaagaaaccctcatggtgcagagtatacgagccctgattacgggtaccgtacgcgaacttccacgcgttcttctgattgatcatcgagaagttcacgcccttgttatcacccatatcatgcacgaccacactgtcaagcacctgaatgcccgggcagttcttggtgatgcgggtggtgtactcggcatcgtcgaaccagatgaagtactccttgtaaggcagaccgtaggcttccatgacccagcgcggtatcaggactgacacgaacgacgcacggttaatcaggaccacgtccttgagcccttccgcccgcagacgcccccaatcccatgtgggcacagggttgttcatctcggatatgtgcccgtcgatgaacttgaccaaggagcatgcgaatgggatgtccggactaaacacatcgacagcccgttcgtatccgtcgaccagcttctcaagtgcatcaggtgcagggtaaccatcgtcatcaaaaatccagacgtagtcagcaccaatttggtagcccttttccataccggccgaaaaaccaccggccccgcctacgttctccggcagagtgacgatctgcagattcacctgatccgcaatcttaaaattgtcggcatactcctgcaagtaagtggcggtgccatcggtggaagcgttgtccacaatcaccaggtgagacggcagcatggtctgtgcctccaaggaagccaggaccttcttgagcttctccaggcggttgaaggtaacaactactgccgcgacattcttactgtgcttcactgtgcccattcctttagcatattttggaaataccggttggcggactgctggccgaagaagctggttaaccttgcattctccacctgccacaagcgttcccgatcttcctcatgctctctgatatgctccatactccgcacggctgcggcaatcaaatcggcagtgcgccgaggcagcaatccctgaactggaatgagcgttgattgagaacctacgtcagcactcaggaccggcaaaccggcactgatggcttcgatagtggtcagggtgataccttcgttcaccgaagagaccagcagcaaatcggcttcctgatacgtatcctccaccgactgattaagaccacggcgttcaatgacatccgtcagaccagcatgctcgattatgttgttgacttcgccatccaaatcaccattgccgtgcatgatgaagtggtaggcccccggatgcgcgtgttccaaaatctgcacgattctaatgaacgcctccggtcgcttctgcctggtgacccttcccacgaacgctacacacagctggcctggttgctgacgagctttaatcgtatctcgtccagtgtcagcggtcagaccaacaagaggtgccatgacaatcttggactgacttatgccgtgcctttcaaccagccagttctccagttgcggagagatgacatggtgcaagtcgatataggcatcccggcttactgcctggttgggataaccgccgcgatagcggtactccaaaatgtgcagggaatcgacgattcgggtctgtggatagtagcgcttaatccaccaaagacggtcgtaaagccattggttgtggtggatcagggtaccgcgcacgtcgaattgttcgaaaatcgagcgcagcaaaggttcatcccccggacgttcctgcatggggaaggtgaggcaaatgactagcgcaccctccagctcaggtttgctgatccacggctgatgactgtccatgttcgtaataacgatcggcgtcataccggcccgtttgactaagtcgatggtctcaaggccccaccgttcggccccaccagcctgaagccagtgcatacccaccagcacagccttaggggcaccctccctaggcttgttcggcttgatgtcgaagtatggatgatgaagccgttgcgcgacttcggctgagctaagatcctgcggaacgaatgggacaatcggctgatagctctgcttctcccggtgcgagcgctgtgcttcacgaatgtagtcaaaagccacgggagcataggtctcgcaagcacgatacaccttgctggcaagcttgacggtctgcttggcttcgatatcctcgtcggtcgcgccatccggagacaacaagatatatcgaacattccggtcgattatctgctgttgaccttcgaaatagtggggagaaaactcactggaaggatctgcggcggatttcgcccgaaactccagaaacggtgtgagccctgctcgctccgtcagatccccactcaacgtagaggtatcagtcagtcgaggatactgccagcgttctcccatatataaacggtaactgagctcccggcctggttggataagactgtggtagttcagagcagccagcaccaatgctcgcaaccgtggacttaacttctcaatggctgcggacacagactcgtccacatcaaataacttaagcatgctatctatgataaacggcaatcgagtaacaagctgcgagcacagccaagcgcacactatttagacactccctataacgaattcctaggacccgcttaagtaagtttgaaatccgctgtcgctattcctcaaccagcaacacaaacacctgaatctctgtaagatttgaaacggatgcgagaataagagactccccagtatacaatctcactgtataatgggcagagtgaaaggaatacagcctttgaaggcaacaactgcggtattactgccctgctataacgaagagcagactatcggtaaagtcatcagcgacttccatgctgctcttcctgaagcagacatctatgtctatgacaacaattcaaccgaccgaacggctcagaaagccaaagaagcaggagccattgtccgtcaagaaccacgccaaggcaaaggtaatgtcatccgcgccatgtttgaggacatagatgccaatgtgtatgtgatggctgatggtgatgatacatacccggctgacgcagcacccgctatggttcaaaaagttttagacggttatgacatggtaattggcgatcgtttaagctccacctacttccaagagaataaacgccctttccacaacataggcaatcgtgtagtacgaggtttcatcaacagtctcttcaacgcgcatgtcaccgatattatgaccggataccgggccttttccttcacctacgtaaagacatacccaatcctgtccaagggtttcgaagtcgaaactgagatgaccattcatagtctggacaagaacgtacgcctgtatgagatgcctatccaatacagagatagaccagagggatcagtcagcaaactggatacggtaggcgatggcttaaaagtcctatccactatcttccgcatgattcgggagtatcggcccctccccttcttcgggggtctaggtgcggtaattgacataaccggcattgccctggtcatttcagtgcttattgacttctggaacaccggagcagtggctcgtttccctaccttgattggttctgttttacttattctagtgggtctactgagcatcgtcaccggcatcatcttggatgtgatagccaagaacgatcgcaagagttacatcactaacagcaatattttctcttacctgaaaagggcagagctttccgacaaagaataagtccctgtttgaaagctcataaaagcgtatagcttcgggacggaggcacatctacaatgaatgctcccccccccccccaccccgaaactatccggatgctaacctgcccaccataattattcaaatcgccagttctgggcttgggtaccattagccatgtatagctggagaccattattgttcgctaccgcaccccctggtaagtcaagaactaaatccgaggacaaagcagaaatgagcttgctgcttccatcgctctgtcggacagccacccacttctgagcataagtcccattcgcctgatattgctggacacgggcaccggaggacatgttcgcaccggcgacgtccatcagtttacctgaaccagcattcatgattgttaagtatccttgactgtcatgccgaacaacccattgctgagcccgagtaccgttgcctgcataaagctgcaccttcccattgttgtcggaagtgccgccagctacgtcaaccttgtatctgttgttttcccctgatgcgattacatagctaccgtccttaacatcattacgatgttgagcagccaactggtctagacgctgccggactgttggctcgttggacagtacccacttttgagctgcagtaccgttctggctgtatatctgcatctgttggccagacacggcttgggctccagatatatccatagctttattggacaggctaccgacaaaactgaattcaccgccaccggaattacgcacttgccaacgctgggactgggtcccgttcagctgatactgctgaactggagcggcgttctgagtctgaccaccagctatttcaaggttatttcctgatctagcattacttatttcataaataccattacccacttgtttaaaagtataaagctgagcatcagtaccattccaggggtaaatctgaatgcgggtgccgctttccattgaaccacctggtacatcaagcactagtcctgtgttgatagacgaccgaatccgataccaagtatttgcctcgatagtagttacagaagcaagggtaaatcgttgagcccccgttccattgggttgatagagagcaacgcgagcattgtcggcagttgaagccccttcgatatccaacacccagttgcccaaagccgattgcaagtagtatgaattgcctgcatcacggataaaccatcgttgagcagtgcttccattgcagtcatactgccaaactgttgcattgttgccagccaccgcattagacacatctaaagccttgcctgagttgacattagtaatcacatacgagccatcgctttgtttgctaaagacgaaacgctgagctcctgaattgttgtaactatatagatgaagaggaacacctgaagccgcgctagcaccagcaatgtcaatgcctgaggaatccttaagccaagagttgatatagtattccccatccggcagatttacccggggcaaatcgtttacattaagctcggccgcgaaatcgtgcaggccgcaagcattcaaatccacagaacctttgatgccgttgatgcggcctccatccgagtactgccagcaacgttcgttggccggatagttgaaaccaggccgagaaccataactggccacccagtctgttctagagcggatattgccggaattcagcgctgtgttcaggtaatgcgtataggaatacaccgacagcttgttgtagccggcgctctgcaattgccaccaccaggagttcacgattccgtcgtataccgcggggttggtgggtggacgatgccccgaccaagaccacagctccaagtcgtagtacaccgggtacttcaaatcccctggtccgacaccagcgcgacgcagaaggtcgacgacattcgcaccctcggaagaggcggtaccactgtcatatgcatacgagtataagtagatgccgaaaggtatgcccaagcgtttgcactcactgatgttgcgcaatgccttgttgtcgaatccgttgccccagccgtaaccgatacggatgatggcaccttccacgccagaattgcgagccgcctcccagttgatatcgccctgccactcggaaacgtcaataacacctttagcttgctgtgcgaatagcccgccatcagcctggaagaaggcctgcgtgccattgtacataccccaatacgcaccatactggttgttctgcaaagccacagttcgggcgggagacggagcggcgtcctgaagagtctgaccgtatgacatgtaacgacctggttcagcatgacgacgaggctgactgtgcatgtttccgctaaagacggactgacgaacggcctcatcaccaccaaccttgctcgccgaatcgggttccttaccatccatctgttccttgactagccccataggaacggggatgaacgagcgtccattcgtcttcgccaaaggatcggcgggtttgctttccgtgccaaccaattttgggtcggtgactgtcttccccgtctttacgtccttggtctctcccgaatccgctacagcgagattcttggataccaaggtcgcaccgtcgggaatcgcatcagaaaccgcatccggcagcttgtcagcaggcaactgttcttcagtcgataccgttgaagcaaacgcctggttatctggttcagcagaagcaaccgtgtcaacgagagcctcagcccatgcaggattagccccggtccccaacaagcacatacccgcagcagcggtcaatgcaaagaatttctgtacaaagctcatgattctcgcacaatcctaggccaagacgatggccatttttatctatttgcctgtttgcaacactgtaatcgctgaccaccgtaaattagccaacaatctccgagatgccacacttccaccataagtgcgcgtagtgatctcaagaagcacagccacagcatgttatctatagccgacagtgcatgcctggatcggcctgatcacagaccaagtgcgaaacgccacgaatcgatagccccaccccctcagccgacacggcagactctgactcgctccgccgccgcaggtccaaagaccaattccactcccgtggatgtgccgctagtcccttccatcaattcgaccacgattgcatcagagtaaggaggctgaggggctatacgcaggagggaaccaacttgaatttgcttgcttttgaggtaacgcagcatctcgggatcctcatccgagacgcgatccacacgtgcaaaggcaccctggggagcctgtgacagagggattgagtccttgcgatcaggcaattcaccagtagcagcggggatggagtcgccatgcgggtcacgatcgggatggcccagcagcgcatctattcggttcaccaaccggtccgaaaccgcatgctccagactttccgcctcctcgtgcacctcgtcccagctgtagcccaaagtctccaccaagaaagtctccatgagccgatggcggcgcaccattcgaatcgcatactggcggccaagagaggtcagatccacacctccatatggccgatgctccaccaggcctgcggccccaagacggttcatggcaccggagaccgtggatagcttgacacctacacgcttcgccagagccgagggctgcaccggactcggatcccactcctgcaggtcccagataatcttcagatagtcctgcgagttcgccgataaatcgtccaaatccataaggaaagtctaacaagaggccagaaggccactcaatgcgaggcagacatcatacagcaggccgccggcgcacaggcaaataaccttcacatgcgaacagtggaaataaaacacagcatccgctagacttcgcgtagtcaaagatagttgtttgcacatacgcagaaataaccatcttcgcagcacgacccggcacgaagtcaggcacataagctcagagttgaaggacagcatggcgagcaaaccagcagatgactcgaacgcccgaccgattgcgcacaccaggaaacaaacacccagcgcagcgcacgaaaacaggcgaacagcagacatgaccgtcgacaacagcgccgagtcaaccgctacagtcaagggcggcgcaagaaatccctcatcccatcaacaccgacccatcctccttgtgcagacagccaacggccgctccctcgaggaggtcaactcctccattcctgtccccaggaacaagacttctttctggcgcaacctggccgccttttcgggccccggagccctggtggccgtaggatacatggacccgggcaactggatcacctcgatcgggggcggcgcccaatacggttacctgctgatgtccgtggtgctcatctccagtctgatcgcgatgatgctgcaatacatgtccgccaagttgggcatcgtcaccggcctggacttggcccaggccacgcgggagcacaccggccgcaagctcagcttcgtcctctggatctgcaccgagctggccgtcatggccaccgacatagccgaggtaatcggcggcgccatcgcattgaagctcctgttcggcatccccctggtcgtgggcgtggcgctgaccgtgctcgacgtgctgatcctcctgttgctcacccatttgggtttccgtcgaatcgaggccatcgttgccgggctgatcatggtcatcatgctgatcttcgtttatgaggtcatcctcgcccgccccgatgtgcccgccatgctagagggtttcatccccaacaagacgatcctgggcaggggccagctgaccatggccctcggcatcgtcggcgccacggtcatgccccacaacctctacttgcactcctccattgtgcagacacgcgacttcgaccgctccgatgacaagcaagtggccaacgcggtccgtttcgccacctgggactccaacatacagctgaccggcgccttcatcgtcaactgcctcctactcgcgctaggcgcggccatgttcttcggccacggcgaaagtctggacaccttcaccgccctatacaacgccttgggcgaccagtccatcgccggccctgtggcctcgggcctgctgagcacactgttcgccgtggccctcctggcctcggggcagaactccaccatcaccggcaccctgaccgggcagatcgtgatggagggcttcatccgcatgcgcatccccatctggctgcgccgcctggtcacccgcgtcatctcgattattccggtcctgatctgcacggtcatcttcggcggcaaggaatcggccctggacagccttttggtctattcgcaggtcttcttgtgcgtggccctgcccatctcgatggtccccctggtctggttcacctcgtcgcgcaaaatcatgggcaagtacgccaatcccaagtggctggccgcactggcctgggtggtggttgcggtcctgtccgcgctgaacgtccaactcgccatccaagatgtaagcgagctgatagccctgctataaacccgtctcaggctggctggagactcatacaaggcacgaccaggcgggcgcgcgccacaaagcgcatgtgcgcgcattgcgatgcccgccttccgccgtttagcgcccgtgttcaattccatgctcggtccaacctcaacccggcacgcgagtcatctcacttcaccgcgagaaccaccccttcctaatcgcaggctacggtgttacggtctaattagggacacgcgggaaaatctcccgtgcaaccgacatgggccggacacattccgactctgcgcgcatggaacaagccatccgatcgcaaacccagccggcgatgctcctcaagaatcgaaagggcgtcatgaacgcaaagctcaccactaacgaaggccagccctggggcgacaacacccacagccaaaccgccggcaaacgcggacccatcctgatgcaggactaccagctgctggaaaagctagcccacttcaaccgcgagcgcacccccgagcgtgtggtccacgccaaaggggcgggtgccaagggcacattcaaactcactcgcgacatgagtcaatacaccaaggccgacctattcaacggtgaaggcaaggagacgccagtgctgattcgcttctcccaagtggccggagaggcaggttaccccgacaccatgcgcgacgtgcgcggcttcgccctgcgtttttacacggccgagggcaactacgacgtggtgggcaacaacacgcccgtcttcttcgtgaacgacccgctcaagttccccgacttcattcattcgcaaaagcgcgatccggccacccacctgcgctcccaagagatgcagtgggacttctggtcgcactcccccgagtctctccaccaggtgacctacctgatgggcgaccgcggcaatccggcctcctaccggaccatgaacggctacggctcccacaccttcaagtgggtcaacgcgcaaggtgagcagttctgggtcaagtaccatttcatcagcgcccaaggcgttaaagacatgaccaacgagcaggccgccaaggcagcctccgaagacacggactatttgctgcacgacctctacagcgcgattgaccagggcgattacccgtcctggaaggtgtgcgtgcaaatcctaccctacgaggaagggttgaattacaagaccgacatcttcgatgtgactaagaccgtctccaagaaggactatccgcgcatcgagattggcgagttcacgctgaatcagaatccggtcaattatttcgacgaagtggaggaggcggctttctcgcccgctaacttcgttcctggcatcgagccttcacccgacaagctcttgcagggccgcctcttcggctacaaggacgccgaacgctaccgccttggcgccaactacgagcagctgcccatcaaccgaccggtcaacgaggtgcataattacgagcgcgacggcttcatggcccagggccaggacggctcggtcaactatgagcccaactcccacgacggccccgttgaggaccatgacgcgcgtatgcacgccgacagcgaggcgctgaccagccaagccgagtactcacgcccctacgaggtggaccacttctcccaggccggcgacctctaccgtctgatgaagccggaagagaaggaccggatgattgagaccatcaagtcgaccctaggcactgtggacagcgaagagatcaagatcttggagaccaagcagttccaccaggccgaccatgagtacggcgagcgcgtagcccaggccctgggtctgtcgatggattccatccgctgaccccgtcaagccagtgaggccgggccttgagcgctcaaaccgctccgcaacccggccccactgcatgctcccgtgacacgccctgcctggcacactcacccgtcggccaaggtgtgtgttattatggagcagttgtgacctggaggattcgcctagtggtctatggcgcacgcttggaaagcgtgttgggttcacgccctcacgagttcgaatctcgtatcctccgccatatgaagcccctcatgccgaggggcttcttttttacatgaatacgaagttatagaagtttgtctacactgccttctctgagacatgatgctgccttgccaaagtcgcacactactcataacgccgatgtgcggcatatgctcttgccagcaaaggccgacgacagcaggagactgggactaacctgctacgtgggtgattatcatccccgcataggacagtaccacgaggatatagcaccagcctaaagccttcttcacagatattttctcgatacccatatcaggcagcagtaaagctacaacaggaataacaggaataaagtatcgactctgaatacccccgatccaggttccagaaggattgggggagaaggagatatacaggcccagctctaccgcaatcagaaaaaggaaggatacgacaccggccatgcccctcacccacttcatgccaggaaaaccgttgacggcgtgagcggacaacaggcacagcaccacaaaggcgaccagcagagggatcatgccacgttgggcagatgaacggtctcactttgaatttctgtgatacgccaaggcccgcaggactttcgacaaacagtctcagcctccccctcaaacagcggcaattgtagcacctcatatggcaatgacggtctaagtccccaccttcggtagcgttcatcgactatcatggccgcatgcctacattcttctctctgagccgctccgcacaggagagactgaacgccttcagtccacgattgcgtgccctggccgaatccgccatgaactaccacagcctgctcacgccaggcgcagccatagaatacctcttttatatgggccaggcccgccagtacccccgactgacagacaccagcacggtcagcggggaattgaccagcgacgcagggctgcatcctttcctgaaagtcagggccatctcatcatcgacgggctcattggcgcagacaggcaaactccgccagcaatcaaccagccatgccgtccgccacatcctacttacgccggaccaggcaaccgatgcggacgctcgcgccatcgctcggggcagcctgcccaaacgcgtgtatcgcatatgcgaggagcacgcccccatcagctttgactacgtccgggaagcacttcgccatgtcgcggagcacgacatgcgcaagcgcatcgcccggatacatgaagacagtcatccagactctgcgcatatgcagtcatctcaggtcgaagcaaactcccacatctccgcgcatgacgcaaaacgccagggcgctgttgtgatcgccgcccactggctgcaaccaggaggagccgaacgctgggccatggaaacagttcggctcgtctctcagacaggcatggtgcccatcgtcatcaccgacaatgacagccaccagctgtggataacccgcccagagctacgctccgccctagtcctatgcctcagccttcctctgacgtccggagcagaggggatgtcgctcatggactccctgtatgggcaattcgacatccgcgccatcctaatccaccacaaccagtggatgtatgaccagctgcccagagtcaaacaacgccacccgaataccatggtggtggattccctgcacattctggaataccgacatcggggagggtatccctgccaagcggtccggtatgatccttacatcgacatccatcacgtcatctccccccagctccgggattggctggtccgtgcgcaaggaatcgacgcaggcaaggtggtactggctccgctgatgggcatgacgacgggggcgacccgaaaggaagtcaagccaaaagccgaagacaataggctatgcgtcgccttcgtgggcagggtgacccgccagaaaagacctgaggtcttcatcaggatctcggcccttctggaacatgcgcaaccaggagcttttcgtttcctcatgcacggcaatggagatctcgacgataaggtcgatcaggagattacgcgtgcgggattgacctcggtggtggaacggcgcgacatatccattccagcttcacagacctacaaggaagcggatgtcctgctagtcacgtcagacaatgagggcttgacgctcaccacaatggaagccatcagtgcgggaataccaacactgagcgcgaccgtaggagcccaatccactctgattcccaaacaggggctactcccccgccgcagcgctgacctggcgagagccgcgacccgagtcttgaagcatctgcttgtcgacgaatccgatcgggctagcctgtggcaggctgaacgtggacgtttggacgagtttgcccgtctgaccaccgccaatgaatattatgaaactatgctgaaacacgaggcttctcacagctcataaactaggcttcaaccgtctgcgcccctattcgcaagcgcgagcgcgcaaggaccaagaaagtagaagcgagcagtcgctaccacggaaggagcgcgcgacgaacatggacatacaaaccggcagcgccaccgacggcacgcaggcttcccttccgttcagcctattgatgccagtgtacgcgggtgaccgggctgactatgtgcgaaaggcgttgctgtccaataccgtggaacagaatctccctccctcgcaagtggtgcttgtccaggatggaccagtcggctcgggcatagcgcaactcctcgactccctcccggctatgttgaccgaacaattcatagcagcaggtagagcggacaagcagcccgaactggaaatcgtgcgccttccgcataatgccggtctggctaaagctttgaaccaaggcctgcgacattgcggatatgatcttgtggcacgggccgatagtgacgacatctccatgcctgaacggtttgaagccatcgttcccctactcaccggtagcgcggggaacaggttcgatgtggtaggcagctttatccaagaattctcggacgagcaggatgacccggggcaagttcgagagcttccgacgggaggggccgaacttgaggctttcgccaggcttcgttcgccgctgcaccacccgagcgtggcgttcagaagatccgtggttgcttccgtgggaggataccctgaagggcaaggaaggttcgaggattacctcctatgggagcgtatgatactggcaggcgcccgcctatgcaatgtcccccttcctttagtcctgtaccgtgtcgatgccggagcctacgagcgaaggggaggattacccatgttcattgatgaactgcgcatgcagaatcgcttccggtccgacggcttcaccaccgccccgcaatttgtgcgaaatgtatgcatacgagccctgtacaggctactgcccactccagtgcgtacagtcggttatcgctgcctcactggcctgcgacatgcgcttcgtcctgtcagggagtagggtcccgtcagcactttcttcctcccagctcacagcgccgcctatataaggagaatggtagatgcaactgtcatcatggttccaggccatgcctttgacgctcacagtcgctggcctgctctacctacccggaatcatgattgtcctagcagctgggcgacgcaagtgcaacgaggtcctggcccttgctcccgtatccgccgtagccttagctggggtggacggtatagtgctctaccccatgcatatccgctggaactgggcgtcctatctcgcctcagcaatcgtccttgccgccttgtgcgggctggcacgtacgtggatggcgaagaggggaacaaaggacaagtccggcaaccgagcccaatctcgcagcgcattcgctattcagaaacctgagtccgacgacaagggcttcctgcgctcggcttgtaagtccctgcccgccgcgagtggaatcattcttgcggcgggaaccatagccggcaggctcattgaagccgttccttcccccgagcaagtcacgcagaactacgattcggtcttccacgagaatatcgtggctcgcatcgcgatgacgggacaggcgtcctccctccatgcgctccccccagtgcgcgacgtgtaccccatcgcctttcagcagttcgccgctttaggcaacgaaatcttctcccaaaccagcaccagcagtagcgtcacctgtacttggctgatattcgccgccctcgtctggcccatttcgatgctgtatatggttcggtcgttagtcggccccctcccggcaacggattttctagcacccgccttatccgccgcaaccgcgggattccccttccttcttctggattggggcacgctgtattccatgtttgccagccaagtcctcctacctgtttttcttggcctggtttggcgctactgccgcggcagcatgaggggcgaacgcgagagctggacgcgattagcgtggatggccgtatcggttctggcaatatcggtatgtcatttccgcgtcatgatgacggctcttctgctcgcttttcccgagattctagtctggttcatcggcacctgctcccggctgcggcagcacaaccgcgcggctttccgcgcaacggccgcagggttcgtggcggcaattgcggcggtggccatagcaggggtcgcaatcttccggaagatgtatctcagcggtgcctcacgccctattgcggaccatctcaacggaggcccagcccagcccactgaatccatcggatccgcgaccctgcgctacttccttggtcaacccatcaattcctccaaccagaggcttcccgtcttctggccaatagcgattgcgcttatcgcagcggttgcgatcatcgtcatcgagcataagccacaaggtctgacgctgctctcctctttcctcctgctcggattcgtcttcgtctcctgcgcgggcagccatgccgattgggcgaaagtggtgaccgcgctatggtacaaggaccagcgcagactgttcgctgcttggccaatcgcaggcatcgcgctgatttcctgggcaatcagcgcggcaacgcgatggctccgtcttcgtaattccctggcggtgccccagggcggaagaggattggaacgggccgggaccgtcggcgctcgctcgcagaggcgcactgccgtaacagttgccgcagtgacgcttatcggcttgctctcctgcttagtcaatccccagatgcgagccatgcaatcggcggtaagccgcacttatgcctttgcggacaactacgcagattcccccatgctctcctctgacgaatatctgctgctcaagcgcttggaccgccatgtgggccccagtgaggaagtggtctccgacccttggaacggcagcggattcatgctggccgtcggtcaccgcactccgtactacgcccatctgagctccatgtgggattacgaccatgagtatctggcgaggcacttcgacagagtggattcagatccgcaggtatgccgcattctgaagaacaacgaccttaagtggtacgtcgacatgggcggcccttatgtgaagaacgatcctcaacaccaggtcttcgaggggcttcggcccgtccttggcgccatgcatcccgtagaccgccagggcagggccatgctgtaccgcattaccgcttgtggcctgtaaatccgtcaccttccacggcttgtatggcctgagcgacttcgggctcagcgcagaagatggaagcattgtctaaggggcgcgttccgaaaccggcgcgcagccctctgcccaggcatttcagtatcagcccgcggtctttggaacgcaggagcgtcagcacccagcgacggacggtctttgccagcaactctccgaactccattacggtgaaattgctggacgaataccgcatcagccaaattttgttgcgcacctcgtagaagaatcgatttccgggatccgcatcgctggagccgaagacctttgttttatggaccacttcgctggctgggacgaagtagccgatgccgtctttgagcagacgggtcgtgaactcgaaatcatcattccacaggaagtaggcgctcctgggcaaagcgcgcgcctttcgaatcgcttgcgcgctaatcagacaggacacgaatgacaaggaacgaacctggtatgcccctgctgatgccttgagggtcctatgccctgctttcacccatgtgcgcggcctgggcttgctcatgccgtgaatctcgccattaatccacaaagcctgagatcccatgaccgtcggttgccgaccattaaggcggctggcctcctcagctgcgtcaagcagcttctccaatgccgtcgaagtagggattacatcatcatccatgatccagatactggaattgtcccagtcggaaccctcctccaaggccagcgcaatgccggcggagaacccccccgctcctcccatattgcgcgacagctgcacgagcttcgctccgcaaggatgctgctgcaccacggaggctgaatcgtcgctgctggcattgtccacgacaataatactgtcgggctttcgggtctgagcttgcaaaccgtccaggcactgccgcagcagctgtgaccggttataggatacgaccagggcagtgacgcgagaaatcatagccacaagtatatgcgccacctcaatagacgtggaaacgcccgaagacctatactcacattcctccaactcctgcactaagccgagtcaccgtggccggcgtgcatctgatccgttcgcgtttgggcagtcaagagaacagccccattgggggaggccgaccgtatcctaaatccaaatcagcgaatcgaggaggtggaggagcatcatggaaggcgctcaccggaacggaaagggaagggttcaggttgtgggcgccgcgatcgtgcgcgagggcaaggtattgtgcgcgcggcggggatgagggtaggtcttccactgaatttggctggattgcgcgagtttcctgcgcgcaaccgcagcaacacctgcaagagcatcggcaggaaggcccgccatgcctgggggaaaggactcccccgccttcacccatcgcggcggacggcccggacaagcaaccgccgccttccatgtttgaggacatactgtccggccttgttcaagctcggatcagcccgccgggcgcatacgcgccacagctaattttcgaccagccgggcagcgccatgcatgacgccatcagcgaggagacagcgcgagcgaccaattcggcatccccgccgccttcgtcaccgccgaagccgcctaggcgctcttccaggacttcaaaaaaccgcccgagagcacgaagcgccaaaacgtcctgccagagggtactgggctgcgatggtgggagacctgggcttctctcgggcgaaaacaaggaacccacttgtcctacgtcttcgccacagtccaggccacgtaccgcccggaagcgctcacgaaattcacgccgaacgaatttggctgcatccgcgtcgacgaggcaagccgtgcagaagcgggaggacgccggaatcacctgaattcgtgtggatgcgggagggcgcagggggaccggaatgggacgagacgcgcttcatcccgctgttcgtgatgcgcaaggaggaggcttccgaaaggaagtactattacctcggccatgtcaacgctataggggacccgtccgcggaaacgactcctcaaagcggcgaccaggcagcccggaaagtgactgtcacgaacctgcatctggcgcaggccctggatagacagctctaccggcacctgacaggggcggaaagcgcatagccgcgcgagcgcctagactaggggtaaagattgaaggaggcggttgcgatggctgcacacggtaataggtccaggaacaacggaagcgggcggggacgcgcggactcggagaatcaggccgagagcggcaagctcgctggcagcggagcggatacgatcgagcagcgggatggagcgagccaaagcaagccggacgcaagcgcttcctcgtccccatccgcagcctcacccgctccggcagacatgtccgcgaccaccggtgacgggggcgagcgtaagggcgatggcgaaagcgaacccaccgatacgggtcagccaagttccgaagccgctgaacaacagcccggccacgaacaggaacaaggcaaccgaacagctcacgatgccaagagccagcggcaggatgcgaccgggactcaaaaaccgcagggaaaccccttgcaatccgggcagggtccgtcaatggcggagcaggccgggcacctggcggggtcagccatgcgcaatgtgcatgagaacagccgtcataatccgctgtatttgggtatggcgatcgcttttggggtggcctcgttgggggccgcgttcagcaccttccccatcttcatctcgctgccagtggcgggtgtgctgctgggcatctcggtttggctgatggggcatgtaggcgtcatcagcctcaagagcgaccagacgccccgccgccacggccgtctattgcgcaccgccacgatcggcaacctagtgggcgcccagatcgtcgtcactgacgtgttcctgttcacgcgactgggcagcgtggcgccagggcagtccagcatggtcgtggcctggctgatcgccaccgccttggagtccttgggcgcggccatcatcgtcgccgccgatcttttccaccggcactgagtcgagcacgctgtgtgggctgtcccatgagatcatgggacagcccacgcatatgccctatcccctgcccaggcccgtcagcggttccggtgcggatgtcggtgtcaggaatatattatttagttggctaactaaataacagcttacggacggtttcggcacccatggaggaggcgcggcacgtatggcccaacagaccaagccagcagatagggacctggcccgggcccaagccgggcagcggccgcaaccacgcccagagaactactaccgactggtcaaacaggccatcaacaagcagaaccggaagctagaccgcttcgtcgcccgctacgacctgaccgccagccaagcctccatcatcgaccacctgtccacctgccctggccacgccgccagccagagcgccatcgaggccgagttcgacatccaaggctccacgctgaccgtcatgcttcagaggatggaagccaagggactgctggaacgcgccgcctccacagccgacgctcgacgcaaaaccgtgcacctgacgcccaagagcgagcgcctgattcccgccatcagcgcctacatcgaccgccagcagctccgtttcgagcgcgagttcggccgcgcccgtctggctgacttcaagaggatgatcgcctacatggccgccagcatcgggctcgacgacgaccaacccgtcgacaagcgccctcccctataggcctcaccagaccctccccccaggcccgccttgagcccagcccgtcaaggcaacccaacaaaaacagcggcagcgtgccagcgcgaagcgttggcccggccgagccgctcgcgcgccccggccgaaaccggtcctcagcccgcgcccaggtccgcccgcgccgcaaccaggacagtatccacttgcatagaaatgtaggaaaacaccacatatgaagacccaaccatccgcccaacccagcccgtccaaggcaacccacccggccgccaccgaccgcataccaggcaaagtcatctgcgccttcacctccgcaggcctgctctccttctccggcgtaatcgtggaaaccgccaccaacatcaccttccccaccctcatgcgcgagttcggcgtatcgaccgaccaagtgcagtggatgaccaccgcttacctgctcgtggtatcgatcatggtcccgctctccgccagtctcaaggcacgattccgcagccgctccctctttgtgacagccaacctgctcttcatcgccggcctgtgcctggacatcgccgcccagaacttccccatgctgctcgccggtcgcgtggtccaaggcctgggcaccggcatagccttgccgctcatgtacaacatcatcctggagcaagtgcccgcccgaaaatcggcacgatgatgggcatgggcaccctgatcaccgccatagccccagccatcggccccacgttcggcggagtggtcatctcccagctcggctggcgctggatcttcatcttcatcctgcctgtcctcctcgtctccctagtcatgggcaccttgagcatcaggcaaaaaagcgagctacggcgggtccggttcgacctgcttagcctgctcctgatcgcgctcaccttctgcgggctcatttacggcttcagctcgatgaccacccgccctttcctgagcctccaggtagccggcgcgatggcggccggcgtggtcgcctgcgccggcttcgccttccgcacgctcaagtcgagcagccccatccttgatttgcgcatcctcgccaacctcaatttcgccggctacgttttggctttcctcctcttccaaatcgcctcgctcggcctggcgttcatcctgcccaactacatgcagctggtcaatggctcctccgcgcttatctccggcctggtcgtcctgcccggcgccctgctcggcgccgccttcgccccgctgggcggccgcattctggacacgctcggcgccaaatccccgctgatgaccggccctgcgctggccctgtcctcgctggcgctcttcctggctttcggccgccacctgagcgacgctggcatctgcggcatctacgtgctttacatggccggcatgggcatgagctcaggcaacatcatgaccaccggcctgggccggctggaccagcgcatgcaatcgcacggcaacgccctgttcaacacggtccagcagttcgcgggcgccgtcggcacctcggtatccgccgcactggtggctgcggggcaatccggcgccgccacccaggccgagggcaccgccgccggatccaccctcgcgttcggcatgttgctggtcctgcttgccatccaatatctcacggtaatcaaagtcacgctcaagcccttccccacccccggcgggcgctgagccccgagtccgacttcgaagcgatggagccctcttctgtgagctgaatcacagttacggggatctgttcgtttctgtgagcttttgaatgcgaccacacctcaagcgcacagccgctttcgccctgcagaagcctggaaaatagaggaaaagcgcacaaaatcggaagcgacagcacatcgcattcgatgatagattaaaagcacgggcgcgccgtgatagcacgtgggcggccacagtaaggggcaccaaggacggtcaacgaccagggcgccaagggcgatgtcgccggcagccgggggctcgcaggaaggaatactcatatggcagaccagaaggatgacgacctgattgtcgtcgatggctcgctcttcgaggaagacgctgagaccaagacccgtgcggccaacaaggtcgccaaacacttcggcatcagcgacgaagcccttgagggtgttgaggaattcaagaaacagctgaccgaccacaaggcctgggacttgcccttcatgggctatgtgaacgaggacggctatggttacgcctacgtgaccgaccaggctgtcgcccctggcggctgggatgcgcacaaggcgttcgagtcgctttcgccggacgtgcagaccgcgttcgccatccgcatgctcttcacccaccgcgacgtggaccgctacggtgcgaacatgttcctccactacgagcgcgggctgaacgtgcgcttcgagatcccaacctcgcactcctactgacgcaacgcgagtagccaagaccacctgaacggggcttggaccagggcccccgccggtttcccatcaccggcgggggcccgcgcgtatccggccgcatcctcgagcacgcccggttatccggggcgtcagtccccgtagtcggttcagcggcccaggcgcgaaatcaggccatccaagtccagtggcttcaggccgtgggcggccgccaatccttcagctcggctgaaaccagcgcgccagtcactggcccggtggcaatccgagcccaggcagacggcgattggcgcgccctggccggacttggcggcgaccatccccagcaggagggcgtagaaggattcgtcgccgtacttgtacatgctcttcgtgttgagctcgacgaccagccctcgctcggcgcaggcatcgataatcagtccaatcggccccgcgaactcgtcgaagaccgcctggcctcgcaggctgggacggtagcggaaggggtagtccaagtgggtcaggacatccacctgtccgcccagggtctgcagaccctccaggaccaaatcgaagtaggcggccgcgtaatcatggtcgcttatgttttggtgggcctcgacctcaatccagtcgtggccacggtaggagtggaaactcagcaggcgcagatcgatggcctccccgcccagcaggtcctccaactggttgggatgctcccggctgtagcccacctcagcgccgaccacgctcttgaggcccggatcggcctcctcctggcggatacggtccatttggcgcgcaatccgcgcgaagtcagggacgtcgtcacggccgccattgaccgaattagccagttccaggtgctctgtggtcagcaacaaaccggcgctccggtccacgtatgaagccagcggctcttcgcagtcgaaggagaaggaggagtgcacgtggcagtcaggaaacatggttgccccctaaggtcgagaggtcagttgatcaggccaccgtacaagacgatgagaatggccgccagttcgatcacgaagaacatggagagggccgaccaggagtgggtcaggacgttcaggggcgagtccttcttgataccgatcaggatggccacgaagaccacggcgaagaccgccacggctagcccaccggccaggatgcccaagttggcggcgttggctaggaccgccgactgctggtagaccacgtaagtgccataccaaaagttgaatttcaacaggcacaggccggcgatcaactgttcggcagccagccccagcaagaagacgattcgccagaaccaggaggaggactcgatgatcgacatccccagggcggcgaaagccaccaaggtgaccgtccacgagatcagcgcgatgcccttcgggtccatcgacgacactatgcgcaggaccccggccgtgtggtgaatcgccatagtgcggcccacgccataaggcaggaggatggataggagagccgccaggatgaaagccacccaacgaccgggacgggcccgcttgcgctcgatgtccgccagggagtactcggagtcggcgattgtggcctccggatgggccgatacctttcgctcactcaaccgctgtctcccttccgctggcatggttacccagctttaccgctcacatgaactcccggtcgtcggcgtcccgccaccggaggagccgacgcgcgaacacagaatcaggataccctcaaccagggcccaactgccagccgcgcgaggaccgttgccgacaaatccagccggcccagtcaatggatcgcgccggacgcccaagcggattaggaccttggcgggcgaagcgcccttggacggctgccgctggtcctaccccatcgtaacccctcaccgggttggacaactgtgcgcagcgatgtttggcaccgtgctccacggccagcgcaaccatcaagccatccaggcccccgccccgcaccctccctaggccgggcgctggccggcagtcgggatagaatcggtaccgatgatcaccggattacgagcttcttggaccacccacgaaccagacgcgcccgcgtcccgcccggcagggtcggtcgcggagcgccggcgcacgcgcacccaagtcccctgctggatcgggtggacgctggcggcgctggcttgcgcctggattgccctctgcacggcggtcggtcccatttaccgggctgacggctcgatagccgacttcggcccgcccaactggctcatcctcctgggcgttttcgccgcatccctaggcctggtggccaagctggccgcaatcggcagacggcgtgggaaagccaggcagtcggcgcaggcggccggcggggctggcctctccggcccgattcctgcgataggcgcgggccgccagggttggctccacggccgcgcccgcttggaagcttggtccgcgacatcccccctcatgcggttgcttggaagggccgtgacccgcgccacccgaagctggcgaacgatcatgctggtcctgctgctcggatgggcctgggcgtggatcactttagtggcggcctatggcgccgatctgatctcccaatccagggaggtgacctcctggctggcccagctgaacggggagagcctgccctaccgccaagggtccacgattatggacgtctaccccacggcccactacctatggccgacgcaccccacctacttgaccgaccagcacaacctgccgctgaccctcctttacggcggctcgctcgccctttcccggcggctgaccggcgccagcgatttggccatcatcatcctggctggtctgcaagtggtcttcgccaccttctgcgccgccgccagcgccaaccgcttccttcagccggcccaggcctgccgactgccccagagcagcggccagccggacatgaagcctgctggacccctggctcgggtggcaatcctcctggtcctcctggtttgcccgctgattgtgttcagcaccatcagcttgaccaagtcccccctgttcgcctgggccttcctttggtggatgggcattggctatgagctgcgcctgacgagggccgccggccagggactgcgcgcccgttccaagctggctctcctgattgccaccctggtcatgctggcctcggccaagtacgcggtctatatcgtggcggtccagctcctgctcgccctcctgaccgaccgccggcggtggatgacctacctgctcacgctcctggccccgcttttggtctttgaagcctgcatggggggcttgttcgccacgggcgcggtgatcaagggggactccatcgagggcaagggcatacagctccagcagatcgcccgtgtggcccaacgcgacccctccgccatccccgctgccgcgcgggtgaatctggcgccgatcatggacctggacgcggccggtttcgcttactaccccaacgacgcggaccgggtcaagtcctccggcaacagctctaaggtggtcgtctaccgttggaggaccgtcaccgcaggcgacatgaaagacttcaaccgggcctgggcgcagatcggccgccaggctccgaccatctacttggacgccttcctggccaaatgctatggctatttcgacctgaccgaccacgcctacgtgccgatggcttattacgtcagcaatggttatgtccaacaggattcggcctggatcaagtactggtgccacggctggcgggaccgggtggcctggttcgcctgcgtttggacctccacgcccatcctaggctggccagcttccggcaatttctgggtcgtgtccagcctgctcctgctggcctacgaagccgctcgcggccgctggagggacatcctgggccaggttcccctgatcctcctcatgggcgtcatgatcgccgcccccgcgaacaacttcgagcgccacatgctccccctggtcttcaccctccccttcctggtcatcgctgcccgccgcgcccagcccggtccctcccattcgcccagcggtcggtgaggcacagccgcgcgaactgccatccggccgcgcggcaggcagcagagaacgcgaaaggcccggaaccaaccgggattggttggttccgggcctttaaagaggcgctagccttaccttacagagtagccaggtccagggggacgccggggctcatggtggaggcgatggtggccttggtgatgtagcggcccttgacggtggccggcttcaggcgcttgatctcctcgctgaccgcgtggaagttctcggccagagcctgctcctcgaaggaggacttgccaatcaggaaggacaggttgccgttcttgtcgacgcggaactcaatcctgccgcccttgatctccttgacggccttggcgacatccatggtcacggtgccagtcttggggttaggcatcaagccgcggggacccaggacacggcctaggcggccgaccttgcccatcatgtcaggcgtagccaccacggcgtcgaagtccaggtagccgccagcgaccttggtcaccagctcgtcgtcgccgacctcgtcggcgccagcctcagcggcggctgtggcctgcggaccacgggcgaagaccaggaccttgacggtcttgccggtgccgttgggcaggttgaccgtgccgcgaatcagctggtcggccttgcgcgggtcaacgctcagacggtagacggcctcgacgctctcgtcgaaaccatacttcggcatggtcttgatcagcgcgatggcctcttccggggtgtagaggttggagcggtcaatcttttcgagcgcctcgcggtacttcttggaacgctttgtcatctgcttctcctatcagcagtcgcggtgcgggctagcgtggccctaccgccaaactttcagtcggtgacggtgatgcccatggaacgggcggtgccttcgatgatcttcatgccagcctcgacgtcgcgcgccgacaggtcgggcatcttggtctcggcgatctcgcgcacctgggccttggtgaccgaaccgaccttggtggtcagcgggttgccagcgcccttttgcacaccggctgccttgcggagcaaatccgcggcgggcggggtcttagtgatgaaggtgaaggagcgatcctcgaaaacggtgatctcgacggggatgacctgacccatcttgtccttggtcgcatcattgtaggccttgcagaagtccatgatgttgacgccgtgagaacccaacgccgggcccagcggcggagccgggttggccttgccggcctcgatctgcagcttgatgagcgcagtgactttcttcttcttttgaggcattgctgcttcttctttctaggaagcggtctgtcgaaagcgcgaagccttctcccgcaactattactttccggcgccctggactaagccctggtcgccaagccttatcagtatgccacccgctggagacgggcggcgtccaattcagacgatcttctcgacctggtcgaagcccagctcgaccggcgtatcgcggccgaaaatcgagaccagcacagtgagtttttgcgtagtgggctccacttcggagaccgctgcagccatcgtggcgaatgggccctcggtgacggtaacctgatcgccaacctggaaggagacctcgaccgtgcgcttcttggcggcggcgggcttatcgcctgcggccttgagcgcttcggacgcgatcatcggggccatcatcttgacgacctccttgttcgacaggggcgtcgggtccttggtgggtccgacgaagccggtcacgccttcggtgtccttgacgatgcggcgggcgttatcctccggccacatgcgaatcagcacatagccaggcacacggacgcggctcacgaccttcttgcccttgtcggtatgcttctcgacctcttccatcggcacctcgacttggaagatttggtcttccaggccgaaggagacgacgcgggactcgatgttcgccttgacacgcttctcgtagcccgagtaagtgtgcaggacgtaccacttgccttccaaggtgcgcagttgcttggagaattcatcgacggccttctgaccggcgtcctcctgcccggaatcagcctgcgcttcctgcccttcaggctgaggggtttgcgggttctgaccgtcagccgcttcagcggcctcattggcggcttggtggacttgctcttgctcaggcgcatcggccgattgaacggcttcgccttcggcctggtctggcccctcgacggagtcggcctggctggcgttctcttgcggagtgggcgcgccctgctcggtcgccggggttgcgtttgcggcgagggcttcaaacccctgagcctcattcatcgcatccgccatttgatcatcactcatgtaaagagccaccttttcgcaaatctacaagtctgtatgaatcagccgaagaccagcatgaccagcttgcccaggccgaaatcgagaaccgtcacgaagaccatcaggaagaggacgaagatgaacacggccacggaccagccgagaagctccttgccggtcggcgccaccaccttgcgaatctcgtcaatcacctgcttgatgaacatgccgatacgcttgaagatattgggcctcttctgttcagaagcctgagccttcttagccatatccatccttcgcttgttcctggaaccaaccattggcagggaaggcgggactcgaacccacaacctacggttttggagaccgttgcgctaccaattgcgccacttccctaaggagatatttgcccatcctacccggccgggtggataccgttgggcagggcgaggtaaaccgccaagtttctactgtagcccaagcctccgattccgtccacccgcgccgcccggtagtgtcgcgcccagagcgaacgtatgaattcccccactgattctccgccgggccccaacccagccgtgaccggcaaaacgcaggcggccggggctacgggtcacaggaggaccaggtcatcccggtgaacgaaaggatgggcgtattgccgaccgtagcggcgggacaattcactggtcgtacggcccatcaggtgtaccgcctcctccgcgtcgtaggccgaaacccctttggccaaggggcgaccggactcgtcacgaatccaaaccgggtctccggcggagaactccccctccaccccagtcacgcctgcgggcaaaagactggctcgaccgccgtggaccgcccgtgcggcaccggcatcagcctggtaggaaccgcgcggggccgaagcgaatttaatccacaggcggcgcgcgctcccccggtgcttgaccggggcgaacacggtacccacagggtcgccgaagagggccggaccagccaggctggccttggtcatcaggaccgggatgccggagaccgcgccaatgcgtgccgcctccagcttggtggtcatgcctccggtgcccaggcctgaggtggagccttccgcgtcaatcgactccatcgtttggaccacatcgggcacgaacgcgaccttcctggcccccgagcgagaaggcggctcggtgtacagggcgtccacatcggtcaggaggaccagggcatcggcgcgcacgatgttcgccaccagcgcggagaggcggtcattgtcgccgaaacgaatctcgttcgaggccagtgcgtcgttctcgttgacaatcgccacgacgcccaggtccagcaagcggcccagggtacggcgcgcgttgcgatattgggtggcttggcgggtgtcttgggccgtcaggaggatttggcccaccttgagcccgtaagacgcgaaagcggtttcgtaatgggccatcagcacgccctggcccacggaggccgttgcttgctgggtcgccaggtcgtcggggcgctcggagaagcccagggagccgaaaccggccgctatggcgccggaggagaccaggaccagccgcgccccttggagacagacccgggccagggcgccgaccagggcctgcaaacgctccgggcgtagatggccactgggcgaagtcagcgaggaggagccgaccttgaccactagggtgcgcgcctgggccacagccctgcgcaccgcctcctcatccatcttggtcatgacgcccttcccgaagcccctaccgcgcccacggccgacccgaggcggccaacccgtcagcctgccgcacccttcggtcgcgttagccgaccgcagcgcaccgccgccctactcctggctgtcctcgtcatcgtcgtgattcagggccttgccaatcaagccatgttcatcccgagggtcgtcatccacagctgggtcggcccaatgcccagccttgcgctcggccgccatggcctgacgcaccgcctggcgggcgtccatcatccggtggtattcagcccgtcgctcggtgttcgtgcgccgacgcgcgcgggggtcagcctcctccagacgcaagtccttgccccgggaggccatcggcgccccatcgagcatctccgcccctgcggcgacggtcggatcccagtagaaagccacctgatcgcggcccaggcctatgcgcacctcgtcgcctgcccgggcgcccgccttgcgcagggagtcctccacacccagcttggccaggcggtctgctaagtagcccactgcctcatcgttgtcgaaattggtctggcgcacccagcgcacaggcttgtcgcccgtgacgacgaaccagtggtcaccatccttgctctgcttgcgctccacctggaattcgccggaaaggtcgtcacggcggttcctacgggcctccaggggacgaatcacgacccgttcatcctgggccttcgattcggccgcgatctgggcgcgcaggccgttcaccagttcggccaggctgaagcccagcgccttgagcccgtcgtgggaggctgtggagacgatgaagacctggtggcccattcgctcaaactcgggacggacgaattccgccagttcccgggcctcgggcacgtccgccttgttcagcacgatcacccgggggcgatcggcgattgggatggctcccaggggcaggtccagcttgtccgcgtacagggccaactcgcgctcaatcgcgtggtagtcgctgattgggtcgcgacccggctccagcgtggcgcagtcgatcacgtgggccaccacttcggtgcgctcgatgtggcgcaggaactccaagcccaggcccttaccctgggaggcgccgggaatcagcccgggcacatcggctatcgtaaagcggtcgtccccggcctgcactacgcccaagttcggcaccagggtagtgaaggggtagtcggcgatcttgggtttggctgaactcatggccgcgatcagcgaggacttgccggaggaggggaagcccaccagggctacgtccgctatggacttgagctccagcatcacgtcccgctcttcgcccggctcgcccaggagcgcaaaacccggggcccgacgggtcttgttcgccagggagcggttgcccagccccccggtcccgccctgagccacgacgaaacggtcaccgggccggttcagatcagccagccagcgcccccgccgcttggattcgccttcctggccctcggccgtgaacacgaccgtgcccaccggcaccggcaggaccaaatcggcgcccttgctgccgtccttgtcgccgcccaggcccatagttcccgctccggcggaacggtggggcaggtagcggtagtccaggaggctgctggcattggagtcggcgaccagaatcaccgagccgccatccccgccatccccgccatcgggaccggccaagggcttgtacttctcccgacggattgaagacgcgccgttgccgccgtccccgcctgcgacgtgaacggtcacgcgatcgacgaatgcgctcataggggcctgctctctcccgccgcctcatcgggctggcacggggttactacgaaaaaagccgcgtccaatcggggcgcggctataaaaggttcgttccgggctattcgctcactccgagacgacgtcgacgaccttgcggtcccggcgcacgccgaacttgacgctgccgtcagtcagcgcgaacagggtgtggtccttgcccaggcccacgttcttgccggggtggaacttggtgccgcgctggcgaaccaagatgttgcccgcgacaaccgcttcgccgccgaatttcttaacgcccaggtattgcgcgttggaatcacgaccgttgcgcgaactcgacgcgcccttcttgtgtgccatgtcttgtcctttcccgaatcaacgactctgccgacgcgctcaggcgatggcggtgatcttcaccgcgctcagctgctgacggtgacccttccgacgtgccacgccggtcttgttcttgaacttctgaatacgaatcttcgggcccttgagctcgtcgtccacgacctcgcccttggcggagaccttggccaggtccttggccgccagtgtcaccttggcgccgtccacgacgagcgcgaccgggaactcgaccgcctcgcccttcttggccgccagacggttgaccttaatcacgtcaccgacctggaccttctcctgatggccgccggccttaacaatcgcgtacatagccctaccttttgtctgcttctaagctgccgcgcctgaaacccggacccgccaggaggcggagcgaaccagacaccagctaatcagtatataagcaggcgcgccacctcgtcaaatggcagcgcgccgacgaaacacgcccagtctatgcctcctcggagacatcgccttgggagtcatcgaaaccggtcgaggccccgtcttcggggggacccacgggaatcgggagccgagagccctggccagactcgcgctcgccctcctcgcccgcgccctcatcctggccctcggaggccttttcggcggccgcagcgatctgcgccaacttggccttcacgtcgggcgaggagcctttgggcgccgaggactccttgacgaccttggacccgtggccgtgcttgttggtcttaacgaacgggtcgccgcccttgaccgcgtaaggatcgtcgtacttgccggagatcgtcggctggtcatgcaggaggaagccgcgtccgccgcaggtggggcactcctcggagaaggcctcaaccaggccctgccccacgcgtttgcgggtcatctgcaccaggcccagcgaggtgacctcggccacctggtgcttggtccggtcgcgcgccaggcactccaccagccggcgcagcaccaggtcgcggttagcgggcaggaccatgtccacgaagtcgatcatgaccatgccgccgatgtcgcgcaggcgcagctggcgggcgatctcctcggccgcctccaggttgcagcgggtcaccgtctcctcaagcgacttgcccttgccgataaagcggccggtgttcacgtcgatcgtggtcatcgcctcggtgcggtcaatgaccagcgagccgccggagggcaggtagacctgccgctccatgcccttgcgcagctggctgtcgatctgccacttgtcgaacacgtccttgcccttgtggtcctccgggtcccagcgctcaagcttgtccttcaggtcaggcgccatcgtgtccaggtagcgctcgatgtgctcgtagacgcgttcgccctgcacgatcaactggttgaagtcgtcgttgaagatgtccctgaccacgcggatggccacgtccggctcgccttgcaggagcttgggacgcttgccatgccagaactcctggcgcttggcttcgatgtcctcccactgccgcttgaggttctccaggtccttctcgatggcctcctcggaagcgccctcggcggcggtgcggatgatcacgcccatgtctttgggggcgattttcgacacgatggacttcagcctcgtacgctccttgtcgggcagcttgcgcgagacgccagtcatgccgccggagggcacgagcaccaggaagcgcccagcgagcgtcacctgggaggtcaggcgagcgcccttgtgtccgattgggtccttggtcacctgcaccagcaccgggtcgccggacttgaaggccagctcgatgcggcggggctgcccctccaggcgggtggcgtcccagttgacctcgccggcgtagagcacaccgttgcgggcctggcctatgtctacgaacgcggcctccatgctcggcagcacgttctgcacgcggcccaggtagatattgcccacggaggagacttcgtcgatgtcggagacgtagtgctccaccaggattccgtcttcaatcaccgaaatctgggtatggtgctccttctcccgcaccaccatcagccggttcacgtcctcgcgcctggccaggaagtcctgctcgatcagctgcgtctgccggctgcgctcacgccggttgtcgcgccggcgctgcttcttggcttcaagacgggtggagccctcgatgtcggtgatctcgtccacgtactgctggcgacgggagcggcggctggtctcctcctcggattccttggagccccggcgacgacggcgacggcgggtcagcccaacctcctcctcgtcgtcctcgctcttgcgcttgcggcggcgcgaatcgcgttcggagcgctcgaccctctcggagccggactcctcctcgtcctcaatctcggaccggctcctgcggcggcgggtgacgggcttggattcctcctcgtcgtcctcgccgtcgtcgtctatgaagcgaatgtcgtcgtcgcgcaggtcttgctcaatctgccccacctcgtcggcggcgcggcgctcctcggcgttgagcctgcgggacctgcggcggcggggctcttcctggctctcgctgtcctcgcgctcatccccctggtcgcgttggtcatcgtcctcgcgctcggcgacgcggcggatgctggtgcgtcccttgcggctgcgggacctgcgcgaggggctcctgcccgaggagccagcctcttcgtcgtcctcgtcggcgcctgccgcgtcctcggccggagcggccgggcgggcggggatgatgggctcctggaagagcagtgaagtcataggcttggcgtgcttggcggacgactgggccctggtggaccgggagcccctggaccccttactggtcttggtctcctggctttcggcgccctgagcgctcccgcgtccgcgctcgacctcctgggccttgcgtgagccccggccggagccctcctcctggctctggacgccttcggtttcggcctggctggtggtatctccggcacgatgacgggcgctgacccgacgggtcctgctggggcggggctcttcgccgccttggttggcggcctcgccctcgccctggctggaggcggcggaccggctgcgacggctggtggcgctgcggcggcgggtccggggctcttcggcctcatcctcgccctggcggcggccctggttagcgctggcctgctcgtcaggctcgtcgtgttcgtcgacccggctggcccggcgggtcctgctgcggccgctcgcgctgccggcagagctggactggctcctggcgctggcccggcggcggctggcgcgttcgggcgcggcttcgctggaggccgattcgtcctcacgtgcagcggcggaggcgtcggtggactggtcggcgctgtcggcggcccggcgcgtcctgcggcgggtccgctcccgctcttcggcttccacctgcactggcaccggcgcgtcggcagccccagcccccctcaccactcggcgtcctcccctgcggcggcgcgcgggcgcggcttcggggttctgctgggtttctttctgctcgctacggtctaagttctgggaggactcgctctgcacggggtcctcatgcgtattattcggcacaatgctccttgcgacgcgctgcaccgggtcgcgctcacggcggcggcgaactctcacaccgcgctctcaccgcggccgcgcactgtgcgcatcgcctggacgccttcaaaaagtcttccgggacgtaagcggacaccgtcgcctgcattcgcacgaagcaatccatgcaaggggatcaacgcctacgcttcacagtggccgtacagagccaccactcctctagtatggcacacttcccctatatccgctccgcattccccaactcatcccaaccctattcgtcatgtgcccgcccatccgccccccccccttatacgctcatcgcgcgagccaccccgcctctccggcaagctcgcccccggccgaggcctgtgtacgaagccctttctcccgtttactgctcttgtcgggttgtttggctgctatactaggcaatcagtgaaggggttttgtgcgttcggatcggttggggagccggattcgctgtgctccgccccgcaatcaacacagatgagtaaaacacgggccgggcgtcgcgtcgcgccaccagggcctgttttggaggggtgatgagtcgtttccgcgccgccagcgccgcattcgcggccctggccatgatcctcctgggggggggggtaattcgacggcccgtcccgcccacgctgaacccaaccacctgacccgatcgggagcccccgcctcgcagaccgtggacggcttcaccctgtcccccaccaaaggccccgccaaccaagacgccatggccacgctgacaccgccagccccgccaaccaacgtgcgcttcacccgaatcagcgcaggctacgatcacagcttggcgatcggctcggacggcaacacctacgcctggggatacaacaacgaaggcgaactgggcgacggcaccaacacccagcgcagcctgcccgtgcgggtgaacacgccaaccggcgtgaccttcacccaaatcaacgcaggaaaatatcacagcctagcgatcggctccgacggcaacacctacgcatggggagacaacggctccggcgaactgggcgacgactccaagattaaccgcagcacacccgtacccgtgcacgcgccatccggcgtgaccttcacccaaatcagcgcaggcggcgctcacagcctggccatcggctccgacggtaacacgtacgcgtggggagacaacagtttcggtcagatgggcaccggcaccagcagcagcaccctgcccaagcgcgtgagcgcgccagccggcgtgaccttcacccaaatcaacgcaggctggaatcacagcctagccatcggctcgaaccgtaacacctacgcatggggagccaactggtactaccagctgggcgacgactccaagattaaccgcagcacacccgtacccgtgcacgcgccatccggcgtgaccttcacccaaatcagcgcaggctgggggcacagcatggccatcggatcggacaactacacctatgcatggggttacaacaatgaaggcgaactgggcgacggcacccccaacctacgcagcacgcccgtgcgcgtgagcacgccagccggcgtgcgcttcacccgaatcagcgcaggctactggcacagcctggccatcggctcagacggcaacacctacacatacggcagcgcttacgcatggggaaataacagcgaaggcgagctgggccatggcaccggcggcaaccaacacacgcccgcaccggtgagcacgccctccagtggcaaccccacgaacacctggaaaaccatcagcgcaggcaacagtcacagcctggccctcgactcggacggccacgcctacgcatggggatacaaccggttcggtcagctaggcgacggcaccaccaacgaccacagcaagcccgcgccggtgctcacgccccggtatgtgatcgacggcgtcgccttcggcggggcaagcgtcaccagtaagaccgtcaacgccaccaccggcgcctgggacatgcacgtgccccaacacaccccgggcgccgtcgacgtgaccgtcgcctaccatctcgacggcctcgacgtgaacggcaacatcgccaaccccagataccagtccggcacggtcaccctgcgttacacgtacgccaccccgtacaccgtcagcttccaactgggcggggcgccgggaaccccgcccgccagccagtactcgtacccggacgacccgcagcccatcaactggccggtccccgacccggtttgggcgggccactggttcgacgggtgggccaaacccgacggcagcccctgggacttcacccaacccgtcagaaacgacctgaccctgaccgccacatggaggaccccacggttcaccatgacccccacccggggcccggacaccggcggagccgccatccacgtcacaccccccaacccgcccgacgacggcatcacctacatgcaggttagcgccggctatacgcacagtctcgccatcggcaccgacggcaacgcctacagctggggcgacaaccaacacggtcagctgggcgacggcaccaccgccaaccgcaacctgcccgtgcgcgtgcacgcccccaacggcgcacgcttcaccagcgtcagcgccggcaacggcttcagcctcgccatcagcagcgacggccgcctctacagctggggatccaacagcaacggccaactcggcgacggcgccgccaccgaccgcgccacgcccgtccccgtcaaccccgccgccgacggcaccgccacctggaaaaccatcagcgccggctactaccacagcctcgccctcagcagcgacgggcacgcctacagctggggaagcaacgccaacggccaactcggcaacggcggcaccgacgccaacccccacaccacgccctcccgcgtcaccgacccaagcggcaccaccacctggaccagcgtcagcgcaggcggctaccacagcctcgccatcagcggcgacggccacgcctacagctggggagcgaaccagtacggccaactcggcagcggcaccaacccccacaccacgcccgcgcccgtcagcgacccggccggcaaacccaacaccacctggaccagcgtcagcgcaggccagtaccacagcctcgccatcagcggcgacggccacgcctacagctggggaagcaacaataacggtcggctcggtgacaacaccaccactgaccgtactacgcccacaccggtctccgacccgacaggcaaacccaacaccacctggaccagcgtcagcgcaggcggcgcccacagcctcgccatcagcggtgaccaccacgcctacagctggggatggaacacctacggacaactcggcaacggcagcagcgactccaacccccacaccacgcccgcgccagtcagcgacccggcaggcaaacccaacaccacctggaccagcgtcagcgcaggcggcgcccacagcctcgccatcagcggtgaccaccacgcctacagctggggatggaacgcctacggtcaacttggcgacggcgccaccaccaaccgcggcacactcgcgcccgtccacgcacccgccatcaccgtcaccggcgtcacactcgaccaaaccaacgcccccgaccccacctggaacaccaccaacaacacctgggacatcacaaccccaccccaccccgaaggacaagccaccgccaccatccactggaccctaggcggctccccccaaaccgactaccccctcacctacgagtactacgacatccgcaccctgcccaaagccggcggcacccccgcccaccagctcgcgggagccaccctcctcgccctcaccacactcgccgcactcaccttcaccggccaccaactcgccaccaaacaccaccacaccaaccaacccacgaccacaaccaccagcagcaaataaccaagcaaccccaacacgcaacaggcccggcagccgcaccaagctgccgggccatcccataccccaacccactacgattaccccccggtcaccaaccccatacctcctgggctaatcagcggcggcgaggcgcggcgaaagctcgcggagccccaacccgccccatcagcgcctaaatacccctctgcgtcacccaagcatgcatggccaccgcagccgccgccccggcgttaatggaccgcacggagccgaattgcgaaatgtaaaccacatcatccgccaactccacagcggtttgcgtgagcccaggcccttcggccccaaaaagcataaggcagcgctcaggaaagtcataggtctcaatcggcaccgcgccgggaatgatgtcgagcgcgacaacgcgagcgtcggccgccgcttgggccgcccgttccaggcggtcgcgttcggcgtcgctgcgggcgacgagggcctgagcgcgcatgtcccgggcctcctgagcaagctcacgcctccacccgctgacaagttcctggatgctcggatggtggtccacgtgctggtagagctcggtcatgagcgcgcccttgcggttccatttgtgggggccgacgatgtggacgcggcgggcgccgaaggcgttcgcggagcggaccatggaaccgatgttgaagtcgtgggtccagttttcgacggccacctcgaaaccatgacggccacgggcgtccaggtcggcgcggatggcttcgaccttccagtagcggtagcggtcgagcacgttgcgccggtcgccttggtcgagcagctccgggtcgaactcagcgccttccggcctgggttggtccgggtgctcctggttccaagggcccaggcctacccgccggaacactggttcgcccgactccatagcggccttggtgaccggattaggctccctcaccgctcgctctcctcggcgggccggaagagccgctcgtcgaaggcgcagacgaaaggcagggcccgcctgctggcatccactggatccaccagctccagttccgttctcagggcttgcccggcctggagttcagcggtccggcccgccccgctgccgactttgctggtctcacccactcctccgaccagcgaggctatggcgaccagctcggctccctgcctgctgacgatgccgcagtccaggctgagctcgttgccgtggcggagggtgaccagggaggaggtctgcacgtacgatttctcactcagccaggcgtccagcaagatgacccgcttgcccgcgattgaagggcctttgattgaagggtaaacgaagtccatcacgaaggcgtccaggtcttgcccccgcgaggcggcggcgtggagcatggcgtcagcgaagggcaccgcggccgcagtcagcgctccaacggcgtcgaagtcgttggtcgaatacccggcatcctccaacgtgtcaagcaggacgtgcccagccagttccgcgccttcatggtcgaaggccaccccagctagctcggtaaaggcccgtccatcaatctcccggctcaggagcgcgcggagctgctcccgggaatccaccagtccgagcgcgtcatcgcccggatagtccgcgacacccccggctccagtcagccgaaatcctgcgcgcccgctgcccgtctcctcgtccaaagcatccataccgccaccctatcgcaccacccgaatctccctgcccccgcctacgcgcctgaaccacgctcctcggcaacttgagcgattggccggtggacccccgaaggctcagcagactggtcagaacaccagaggcgactgttcgttggggtcagcgacggcttgggtctcgggagcggtgagttcccggatgtcggcttttcccgggtcgatcatgtccacaggggcgatgatcgtggcggggtccacgttctgcagcttgcgtgcggtgggcaggacgcgcgactccaaggtgccggcgaactggttgtaagccttgaccgtgcgggatatggatgcgcccagggcgctggcacgctcccccagcttggcgaagcggccgtagagctcgcgggtcaaggtgaacaggcgcttggcgtcgtcggtcaatgactgctgctgccaggcgtacgccaccgacttaagcacggcccacagggtcaccggcgacgtcagagcgaccttctgggcgaaagcgtcgtccatcagggcggggtcggcctccaaggcagcttgcaggagggactcgctggggatgaacgccaccacgaagtcgggcgctgtctcgaaggcgttccaatactgcttgtcggccagggctttcacatggtcgcgcagggccttggcgtgggctttcaggagttcgttcttgcgggcgagctcctcgtccgaggcggtgtcggggatctcgcaggcgcgctggtagtccgagaaaggcgccttggcgtcaatcgggatggtcttgccgccgggcaggtggaccaccatgtcgggccgcagcaccttgccgtccgccgccgtgacgaccacctgggtgtcgaagtccacgtgctccaggagccccgccgactccacgatgttcttcagctgggcctcgccccaagcgccgcgcaccttgttgttgcgcagggccgaagccagtgagctcgtctccttgtcaagccgcccctgctgctcgcccagggacttgagctgctggcccagagcgcccatctcctgcttgcgcccctcctcgatctggctgactttctgctggagggcgtccaagttcttctgcaccggagccagggcggagaggaccctgctctgctcctgcaaggccttggcctgctcctggcgtttctgctcctgaagggcctgggcccgctcgcgctcatgagccaggcggacctgctcggcctgctgagcttgggccagctccgatttgacgaatgccaactgctcgttagcgccttcgaaccgcgcccggtactgggccaccagctcctgggactgggacagctgctcgcgcaggtcggccagctgctcatcggcgtcctcgccaaccctgccctgggccacgcgaagggcgtcccgcccctgggtcttgcccaggatatagccgatatagccgcctgcggccagggagagcgctatggctataatcagcacaatcatcgaagtaaggtcgaacatatgttctagccaaccataagcattggacgcgggagcgcaattcgcacgttccgcaaggaatcaggcgaatcaaccccattcaggcgcattcggggggacaatggggaaagaagcttgataccgctcgcagtatcggcaggggctgcgatacacgccgcccttgccatgaggaggcccagtgggaatcgacatctttctggcggtgggcgacatcctggtggccgcggcgctcacctggttcatcgtctggtacttcctgagccctcaccggcggacccgcagcggcggagcatccggggagcgcacagcagggcaggccgccgcagcgtcggaagcgcgcagcaacgggccagggctcgcatcgcgccaggaggatttggaaaccttgcgcaggcgcaccgccaagctgaccctggcctctgcgattctgaccgcgccggtcctcgccattgatttgtgcgacaggttgatgccgggcttcctgccctcctggctggccagcccgtggattcaagccatcctgatcacgcccgtggtcttttactgcggccgtcctgtctgccaggaaggctgggcccggctcagggcccggcagaccgacctgaattccctggtgtccatcgccaccgccctggcctacgcatacagccttgccgcttgcgccctgaccgggctcctgcccgagggctcccggcagccttacttcgacgtggttggcgccattatgaccctggcgctttttgctcgcctatgcgagctgagcgcccacacggccgccctgaccggacgcctgggcccttcgtacgaccaggatcgcggccaggcgctgaccagcagcgtagcggccaccttatccaagccatcctcggcccagctgcgcgtggagcggctgatcgccagggccgagcctcttgtgatgatcgtagccgtgtggaccttcatgatttggcttttggccggtccgcagccccacctggcccatgcggtggccaacgcggtcggcgtcctgatcatcgcctgcccaacggccctggccatctccgtctcgctgactttccgcaccgcgctgggggccgggttggctcacgggatgctcttcacgtcgccccgctctatgggacatctggcagccacccaagtggccgtgctggacgaatccgccctaggaccgggactagcggcggacgaggactcctccgcagcggctccagccactgcaaccgccgacaacgagagcccggacggctacgcccaggaaccctgcgcggaactggctcgcgcgtccacccacttgcgcggcctgggggtcaaaaccgtggtcatggatgggggtcatggcgccgaccccgccttgggccatgagcaggaccctgtggagcgcgcggcccgccaggccggcgtggactacctgttcaccggagtggacggccggcgcaaggcccgctgggttggactgatagcgcaagacctgaaccgtgcggccacgcaagaggtcaagcgcaagaaaacatcgagaaggccgggcctggtggcgttcgccgccttgggaaacgccgagccacaggcgcggcaagccgctcaggtccgcatacgtttagggtccgtagcggcggggcaggccgagagggacgctgacgcggccgccggagcagccaccgccgaaggccgggacgccgccgaaccggagctcctgctggctgcgggcgacttagggggcatcggccgggccatcgacctggccagggccgcccgacgcacgatgaaccagaacctgtgctggggctacgcttataacctcgtggcggtcgcgctggccaccggggtgacctaccccctcttcgggtggatgctcaacccgatggtcgcgccggtcgccacagcgatcgcggccctactgccgatgttcaacgtgcgtcggctgggccggctcaggagactttcccgacgctggcgggtcttggcccgcgttcagccggagctcctgccgaccttggcggcccaccgtccgcaggtcatcgcggacgggggccgtcggttcacgctcaggcctgaggggccggaccggcagccgggttccgctgatcgcccggagtctggtcttcccggctcttctgacctgcctgatcagactcgtcagtagcgatatcatccacgctcacgtcgtccaccagcttgtcggtgggccaagcggtcagctccaggtgatcaccgccggtctgatcgaccaagacggtatcgccgtcgtggacgctgcccgctagcagcatacgagccagctggtcgcccacctcggtctgcaccagtcgacgcaagggccgggcaccgtaagccgggtcgtagcccatgttcgccagccactcgcgggccgcgtcggtcacgtccagggtgatcctgcggtcggtcagccggctggccacctgcttgacctggatgtccacgatgccgcccaactcctcgcgggtcagcggctggaagatgaccaggtcatcaaggcggttgatgaactcgggcttgaaggtggcatgcaccgcgtccatcacggcctcgcgcttagcgtccgcgtccaggtcgccgcccaccaggaactgcgagcccaggttggaggtcatgatcagaatcgtattcgtgaagtccacggtccgaccctgtccatcggtcaaccggccgtcgtccaagacctgcaagaggatgtcgaagacctccgggttggctttctccacctcgtcgaagagcacgaccgagtagggccggcggcgcacagcttcggtcagctgcccgccctcctcgtagccgatatagccgggggcggcgccaatcagccgcgagaccgacgccttctccatgtactcggacatgtcgatgcggaccatcgccttctcgtcgtcaaagaggaagtcggccaaagccttggccagctcggtcttgccgacgccggtgggccccaggaacatgaaggagccggtcggccggttggggtcggagattccggcccgcgagcgccggaccgcgtccgagaccgcgcgaatggcctctttctgaccaatcacccgcttgcccaggtagtcctccatgtgcaggagcttttcgttctccccctgcatcaggcggcccaccgggatgccggtccagtccgagacgatctccgccaccgagtccgcgtccacatggtcgggcaccatcggctcctgcgcgggcaggccgtccgaggcggccccgccggtcgccgcggagccatgaccggccgcggccttggccttgtcggcttcgttctcagcctcggccagctgcttacggatggttggaatctccccgtagaggatgcgcgaggcctcttccaggttcccctcgcgggtggccttatcggcttcgacccgcttggcgtccagctgggcgcgcaggtcgccgaccttgttgtgcccggccttctcccgctcccagcgggccttcagccccgagagcttctcgcgggagtcggccagctcggcttgcagcttgctcagccgctcctgggaggcggggtcgtcagccttcttcagctgcatctcctccatctccaggcgggtcaccttgcgctgcagctcgtcgatctcctccggctgcgagtccagttccatccgcagatgggcggcggcctcgtccaccaggtcgatggccttatccggcagctgccgaccggtgatgtaacggttggacagggtggctgcggccacgagcgcgtcgtcgccgatggtcaccttatggtgggcctcgtagcgctgcttgagcccgcgcaggatggcaacggtgtcctccaccgacggctcgcccacgaacacttgctggaagcggcgctccagggccgggtccttctcgatgttctcccggtactcgtccagggtggtcgcgccaatcaggcgcagctcgcccctggccagcatgggcttcagcatattgcccgcgtccatcgagccctcggaggccccagcgcccacgatggtgtggatctcgtcgatgaaggtgatgatctgcccgtcagcggacttgatttcgttgagcacagccttgagccgctcctcgaattcgccccggtacttggagccggccaccatcgaggacaggtcgagcgagatgagcttcttgccttcgaggccggtgggcacatcgccggccacgatccgctgggccaagccctccacgacggcggtcttgcctacaccgggctcaccgatcagcactgggttgttcttagtgcgcctggagaggatctggatgacccgccggatctcctggtcgcggccgatcaccgggtcgagcttgccctccttggcctgggcggtcaagtcggtggaatacttttccagggccttatatgtgccttcggcatcggggctggtcaccttggcgccgccgcgcacctggggcgtggcttggcgcaaggcctcaggggtcaagcctgcctggtcgaggatgtcggccgcctgcgagggacccaccgcgatggcgatcagcaggtgctcggtggacacgtattcgtcgcccatcgcctgcatttccttggatgcctgggccagggccatgctcagttgccggctggcctggggctgggtggatgccgaggatgaggccgaaggcagcgccaccagggcgttgcgcacggccgcgccgacccgctgggggtcaccgcccgccgcctgaatcagggccgggaccacgcccgactcctgccgcaggagcgaatcaagcaggtggagcgtatccacctgcggattgcccgcagcggctgctgactgtatcgcgtcgccaatggcctgctgggccaaggctgtaaagttctcttccatgcttcctccgcttcttgcgcggcacctcctcagcttgtgcttcagtggcgccgcctgcgtcatcgtctgctatgaccaacagcgggggttcggcaagtattcccaaacttgagcctcaaggactcaagtttcatatcgctacttcgcggcgcttactcctgctccccgatcacgacgttgcgcagggaaccgatgccatcaatcgtgaccgtggcctcgtcgcgggagtgcagctggcccgaaccggagggcgagccggtcatgatgacgtcgccgggaaggagggtggagaaagaggagatgaaggcgatttgctcagggatggagtgaatcaggttggcggtggtgccgcgcgcctcgggcacgtcctggccgttgagctggaaggagatgcccgcgtgggccccatcgagctccgtctcgacccaggggccgagcgggcaggaggtgtcgaagcccttggcccgggtccacgtgggatcggagccttggatgtcgcgcagggtcacatcgttgacgcacgtgtagcccagcacgtaatccaaggcctcggcctggctgacccggcgtgcgatgcggccaatcaccacggccagctcgggctcgaagttcatgttctggctgtatgagggcaggacaatcgggtcgtccgggccaatcaccgaggtggatggtttcatgaacacggtcatctcttccgccgactgcggcttgatctgcggattatcggccacgatcgcctccgcgtgggcccggtaattgaaggccaagccgtagaccttggacgggatgaccggcgccagcagcctcacccagtcatcatcgatcctgtagcgattgccggtcggctccacctgttgcccggacagcgggtagccgtcaatctcgaccagataatcctcgccactcgcctggtccttttgcacaaaggcgtagtgcggattgccgttcatggaaaagcgtgcgattctcataggcacattctacccgcaaaccccgctacgcgcgccgggcatcaggcccggtaaccacgcgacaagccgcgcgtgaggccaggccacgccctggtccactcgggcagcgggccgctagataaacgcgcgcttcccgaagatggcggcgcccacgcgcacgattgtggagccctcagctatggcgtaggccatatcgccggtcatgcccatggaaagttcccggcaggaatccgtacccgcctcgcccgaatcgcgcacgcggtcgcgaaggccgcgcaggtgtgcgaatccgcgtcgaatggtccgctcgtcgtccacgtgcgcgccgatggtcatcagcccccgcaagctcagcccctcggtcccggcgatccgataggcgagttcctcggcttcgtcggggctacaacccgacttcgcggcctcgccggattcgttgacttccagcagcacgcccacgctcagccccctggcttgggcccgcttgcccagcttgtccgccaactccaggctgtccaccgattcgaccgtatccacgcaaggcaggatcttgttgatcttgttggactgcaactgccctatgagatgaaaaccgatgcaggaggatggccctgcaaccgaaccgggtccttgacgctgccccagggccagctgtcgctgggcgcactgcctggtcagcccctcgaacttggcggtcacctcctggggcctgttctcgccaatcaaacgaacgcccgcgtctatggcggccatgatctcgccgacgtcgcgggtcttggtggcggccagcaagcgcacatcgcccggccgccgtccagcggccgcctcggcctcggccatccgctccatcacccgatgcacgccgtccgcgatttcgcgcccacgctcggtgggcaggtcctccttggacagatccttgtgctgcatatatgccgacacgctaccacctcaccgtttccacaggtctccagcctagcagcggccgccaaacctgtcagcagccgtgcgcgggcgaggatatggattcatgcgcgacctacgcggacctgcgacgagaacgctcaggccagaacgctcaacagctcctcgtccacaacccggtcctgccggtcagcggccacagccgaccactcgaagcgctcaaccagggaagcggcttccaccggttccgcccgcggcaccagccccagcagccaggcgcacaaccccaccacctgttggggcgaactgcctcgatcgcgcaaggtgcccaagtccagcgagccgaaacgcttggaaagccggcggccatcggccccgtccaccagaggcagatgggcccaagacacaggctgcgcctgcttaaagtcgccgccagcccctgcttgcaaaccctggcggatccacagctggataccggtggagcgcagcaggtcacgcccgcgcaccacctgattgacgcccatctccaggtcgtccacgctgaccgccagctggtaggagacgatgccgtccgatcgcaccaccaccacgtcacccagagcatggggcaggtcgaaagtctgcgcgccgtacaccgcatcgtcgaagcggcagacggagccgggccgcccctcccccggaaccgcgatgcgccaggcatggcgacgaccctcacgcacccgctcctgagcgagcgcgcggtccaaaccccggcaggtgcccggatacaggatgaagccatcgccctcgttgggagccgaagcagcccggatatcggcccgcgaacagaaacatgggtaaatcaggggttggacgtcttgcttggagccatcccccgaatcgccggtttcagccccaccagcaggaccgagcgaagcggcgacctcctccacgctcaggccttccaagtgctccatggcctgccggtagaggccctccctctgggattggtagaccaccggcccgtcccagtccagcccgagccaggccagatcgtccatgatccagcggtccgcatctgcgaccacgcgcggccggtcgatgtcctcaatccgcagccggaccacgccaccggaggcccgagcccccagccaagccgccaatgccgcatacacgttccccaagtgcatgcgaccggtaggggaaggagcgatcctccccactaccgcagtatccgcttggtccaccaacagcccccgaatcagaagcgggtaaggagttcttcgacgctctcgatgcgcttgaccttcgggcgccagaccggccatccacgggcgatcaccagcttggggtcggccagcacggacaggtccttgaccgggtcgccgtccaggacgatcatgtccgcgtccttgccgatggcgatcgaaccggtgacgtcatccacccccaggttgcgcgcattgacctgggtggccgcgtggaaggcctgggccggggtgtatccagcgaaacggaccagcaggtccagctcacgccaagtgttgtactgggtgaccagagtcatgccggtgtcggtgccgacaccttcgctgatgccttctttcagagcctggcgggcgccttccaacatcccctcgaccacctgctcggagttggcgcgcgcgatgtcggatatgcccagctcttcctgactgacctcgatcagcggcagtccggcggacaaggtcgagttcaggccggagaagccgcgcagggagcgggggttatggtggaagagcgagatgatctcatcgtccatacggcaaccgtgctcgatggtatccacaccagcgcgcagggccgcccgcacaccttcggggctctgggcgtgggccgcgacgatgacgccgacctcgtgcgcttcctcgcacacggccgccatggactcctcgtccatctgggggcttccagccacgccaacttccttggcgtcggtcacaccgccagtcgccgccactttcagggcgttcgccccatgctccaggttgatcctcgcgttgagccgagcctcttcgggggtgctggacgacagcgcgatataaggatccccgtggccaccggggatggagagcatgggaccggaagcgaggatgcggggacccatggcctcgtccgagtcgatcttgtcccgcagggccaccgcttcgtagcccgcatcgccaagcgtacggatagtggtcacgcccgagttgagcagcgccttgacggaggccttggccctggccgccaaataagccttaccgatcgggccgcgaatcagcgccagagcggcgcgctccttgcgcggactggattcgccggcctccaggaccttgccgtccgcgaacagatgggtatgggcgttgataagtccgggggcgaccaccttgccggtcgcgttgatccgatggtagccttcgggcacatacgcctgcagggagggcgaaatctgctcgatacgcccgctgtcaccgaccacaatcgttgtgtccggccagagagtgcccttctcatcgccacttgccacgtccgcgtgctccagagcgaacggctcccgcgccttcctaccgacagcagaactcatgatgttttcctttcgtccggtccgggggaccgccgggcggctgctcgacaccttcccagtagcttccatcgtagtgccaaacggttacggaaagcaccccctaaaccccattacgaataaccagaggcgaattacaaaaatggcccgaggcatatcgcctcggaccacttgctctctgtgcccccgcgggggctcgaaccccggacacgctgattaagagtcagctgctctagccaactgagctacaggggcgtagcacattcaagagccaagatgtaactatagcgctttttcgcaggggcgcaagtaagcggccccatcggcgcgccggggccgctgaccttgattcggcgcgccaactcacgtggaccccttgatcagacgatcttgggcatgggggtggtcaaggacttggtcaggttgacttggaccaggccagcgcccgtgtggacctccatcttcttcaaggtgacggtgcgttcggcctcgggagcggagtcgtcgtcggtcatggtggccggggacttgaccgccaccggcaccaaatcgttcaagtcacgcccttcggcatggcacaaggcccgggcgttggccagcgaatcagcgaaagccggggcggcctgcacccgttcagctggcacgccgtatgccgatgcggcgatccagcgcagctgatcgaccatatccatgcctttgtggctacgtaaggcctcggctggagcttcatcccgcccccctgcctgcctgggccgcaggaccgcgatcagggcgtccaactgactggccagggcctcgcccccgtcgcggaagaggttgcccaggatcggctcgcgcaagcccaggccggccgcgctctccttaagctcgcccacctggccgtcctccccttcccagaggttgaccagcgggaaagcggggatgccaagcccctccatgcggttgacgtggaaggggtagcgccagcgcagggccggttcgtcacgccaggtggaggcgcgggtcacgacgaccgccgcggccggccagggggcgccgaactcgcgggcggcgatgtccagccacttctgggcgcctgcgtcggccccgtagccggcctcgacgacgaccacatcgtggcgggcgcatgccatctcgaccgagaccaggctggggatgcccagggagacgttggcgaacggcccgcagtggacgtagaccggggagccggcctgggtggtcatcatggcgggcttgaccgcgtcggccagcatgttcgtaatccgccacaggtcgatgaactcgccgaaaagcactggtttgccatccagggtgccggcggtcatggccgccacgcgccgggagatctcctccatcgagcgcgagaggaccacaatctgcatcagctcgcaggtaggcgtcaggaccatgcgctcggggatgttggacttgccccggtccacgacgatctggcgcagggcccgcgaaggcacctcggagactcggggaaccagaatttggtcaagcaagccctcgtcaaccgccttctccgcaaaggagacgaggaggttttgggcgttctcgatggccgccatctccccgcacagcccccagtccaccagctccgggtgggccaacgaggacttgccgccgccggaggccccgccttttgatccggctgcggtgatgcccatactgggctggcgcaggacggcggccgcgtccaccccccgctcgcgcagggcgtcgatcagggcgatcgtcgtcgtggtcttgccctcgccacgggaggctttaagcggggtatcggcggtcaccaggaccaccttgccacgcttggtccgctcctcggggtgggtttcgagataatccagatacccgaaggcatccaccttgctgaccagcccatacggggccacgaattcatcgaatgcgctcatgccgtcctcctgattcacgctctagccgctctccgccgctgccttctccgccagctcggcagcggatgaccacgatggttgcggcaatcacagcgaccgtggctaccgaaccggccaccggacgcctgaaagcgcggacaggcggcgcggccccgcccgtacctacgcgcggcggggcctagtccttaccagtatccgccgcttggggcctgatcgcgctcccaagccgacggagaaatccggctcagtggtcggacatatggtaggcgttgcgcatcttcagactgaccgtgtagagcacctggcccagcaggtcgtcggtctcggcccgcagctggtcggccatggactggttggcggcttgcaggacctcgcgcacctccgcgttgccggtgccccggtcggcgccctccaagcggttgacctgctcgtcggtcgcggcgatcatccgatgacccagcccgccgatgcgctgctggtagcgctcgttagccgcggccgtgtccgcgaaggccgagtcggacagggcggcgatcaggcggtcggaccagtacagggtgtcggtggagacgcggtcgtccactttcgacaggtagtcgggcgtggtgtccacgttcgcgtagaagggaatcagcgcattgtagacgttggagccgaaggccatccactgaatcgccctgcagccggccggggcgtagggacgcagctgaatgacggccagctggtcgttgcggttgatgccaatcgggcggaagagccccttggtgtgctcgtcgccgatgatcgcgtaggggtcgtaagcggtgccctggtagtgggagctcagcgcgtacttgacgtcttcaatcgtcaccttgcgctcaggctggcggcaccaggggatgtcgtcgctcatggggttgtggtcggcgtccggtccgtcccacacctcgtcgtaggggttgaagaagcgctgcatgtaccaggcgcgcggcgtgttgtacacatggtcggagtccgagtgggagccgaaggcgtagcgggggttgaacggggaggcgggctccacggccaggtccatatggttggcctcgatgaactcacgcaggtccgccgagcacatgcactcgctctgctcgcccagcgcgtcgtccaggtccagctcgtcgatgcccagctgattgggcatggtcacgtagcagtcgtcaggcacccgacgcgcgatccagtggtgaccgccgaccgtctccatccaccaaatctcgtcggtgtccgagaaggcgatgccgttcatctcgtaggtgccgtaccgctccagcagggcgcccagtcgctgcacgccctcgcgcgccgagcggatgtaaggcaggacgatggtgaccaggtcctcctcgccgatgccgccgggctgctcagggatgtagtcggatgcgccgggctcaccgaccgcaggggtcaggtccaccagcgggtccgcgccaagcacgcgctcgttcgtggtgatggtctcagtggcggtcatggccacattggcttcgttgacgccgttctgcccccagatgcccttgtcgcgcagggagttgggcaccgccgtgtaccgcatcggatcgtcgggcagctcgatggacacgtggctgagcacgctggtgtagtgccggggctgttcctcaggctggacgacgatgaactgcttggggcggaactgaccgttggcggaatcctcgttacgggcgatgatagtggagccgtcgtagctcgcgttcttaccgactaggagcgttgtgcagggcatgtggcgcgccttcctttccctggccgatcgcaggccaagcggggttgctggaacaatccgcctgagtctcctgcgccggcctgcacgcaggaggcgtcatgcgtggcttccactctacagtccccaagtaacgggtggaagacctgggaccggtacggcgccaaggctgggcgccacttccggccattaggcttcagcgggtagccaggcctcggtgacggccagcacgtctgggttggcatggaccgcgtgctccagggcgttgagccagaacccatcctccagaccaggcaagggttggccgctggcccagacccgcaggacgtagtcgtgggtctggtcgggtggcgtgggcccgttgtagcggcaggtgagcgcgggattagtgccgcccacgaatttggaagcggcggaagtacggccctggggtacgccggggaccaagccgggcaggcggcgggagtagtcgcgcggaatcgaaaccgcgactccggcgccgctcggagcctgggtctgatcctgctcgcgcacccgctcgaccggcagattggccagggaccaatggatccactggaaaccgcagaccggaatcgagtcaggatccaccagctcccagctcaggaaactggcggcttcgggcacgccctccagacggaaggggaaggagatgataggcgtgccctccaggctggcttcagccggggcgtgcttggcgtattcgttggggatgaccgcaaaatcggtgatgattctcataccgctattctcgcgcctaatcccgctaagtcaacccggcgcaggaccggttcgggcgcatgccgcgagcgaagggccccctggctcagaccaggaggttgcacatgagggcttccaaatcaagcagttgcgatccgttgccctcgatgcggcgcctggccacgctgatttgctggatgcgttcaatcgccccgcggcggtccagccggaccgagagctcggtgatcgccgccctgttctccaagttgaccaggccgacttgcgactcggcgtcgttctggaggacgcacacatcgcggtagaccgaagctaaggtggtcagcccccggtcgagcacgtcgcgcgaacggcgcacggtcctccgccgcagttcgtctttgccgctgatctcatggtaggcgcccaggagctggcggggcacccgttcatcggccctaaggccgtttattctgcggaagttggcctccaagctcgcaatctgacggttggcgtcacgcgcggcctggtcgcgggcctggtcggccaggcgcacggctaagagcaccgcgtccgaggcccggcgcatctccagcagtccgaccaccagctcgtcgcggtccttaagcacctgctcgtcggtggcgtacatcttggccacgcctatgtgcccctgggccaggcgggcggcccgggcggcctgatgctcgtccactcccaggctggtgcgcaggaatccagcgaccgccgcattggtcggcacggccaggttcacgatgcgggtacgggaacggatggtggacaggacgtcctgggcgctgggggcgcacagaatccagaccgtgtggtcggccggctcctctatctccttaaggagcacgttggtggtgcgctccatcatgcggtccacgtcttcgatcacgatgacccgccagggcgcggtggagggcatctgctcggagaccatgatcagctgacggacttccttgatgccgatcgtcaccttctccgtggtcaggaaggtcacatccgggtgggcgccagcgaagacctgccggctctcgctggtgggttcatcgcccataccgtggtcgggactgaccagggcggccgcgaaggccctggccaggttggagcgacccgatccgggagggccgcagaagagccaggattgggtcatgtcgtcgcgggaggtgccttgcgaggccactacccgcttgaggaggtcaaccgcatggtcctggccgaccatcgagtcccagacgctcaccaaccttgccccgtccggcttggaggctcgtcctcggcgtccgcgtcatccgcatcgtcgtcgtaatcatactcatcgtagtcggcgtcgttcaagtcgtcgccgccatcgaggatctcatcgctgtcctcgtcatcgccattatcgtccagttcgtcctcgacggcctcatccccgccgtccgcctcatcgagacttaccgcgtcgccgtcgtcctcggcagcgaccggcatggtgggtggcatcccggcggtcagggtctccaggtcgcgctgtatgacgctccacacctcgtcaacgctcagggaggcgtcaatgaccagaaaacgctccgggtcttggcgggccagttccaggaacttggcgcgcacctgttcctggaaagcgtcgcctgcagcctccaggcggtcgggctcatcgttcacccgcgcgtgggattgggccgggtccacgtccagcaggtaggtccgagccggctgcaaaccgtcagcggcccaggagctgagcttgacgatgcagtcctcgtcgagcccacgacccccggcttggtaggcgattgaggagtccgagtagcggtcgcacaggatgatgtcgccgcgatccaggtggggccggatcacctgggccacgtgctcggcccggtccgccgcgtacaggagggcttcggttcgcgaattcaggtcgtccgaggagtccactacgtcggtgccggccgtcacggcgaaggaggggaaggcgcacatgccatgcagaaccagctcacggatggccagccccgccggggtgccgccgggctcccgcgtgatcaacgagcgcaggcccttggcctggaggaaatcgtacgcgcggcgggcctgggtggtcttaccggcgccgtccacgccctcgaacgagatgaacaatccctgactcatgcctggtcctcactggtctggcggctggcgcccttgctcgacgtggcaaccctagtcctgcgcgtcgacgcgcctgtggacttgcgggcgctggcgggcttagtggcggaagccttgccgcccgccgccttggtagcggtggacttgcgggtgctggcggtcttcgtcgccgcccttttcaccgtggtcttctcagccgcagtcttcttagccgtggccttctcagtcgcggttttcttcgcgccggtcttcttggacgccgtccccttggccgcgctcttgcgcgtagcggtccgcttgcgccgcttggtcggaccggcggcccgcttttcagccagcaggcggaatgccacctcgggctcaaccgaggctggcgtgtactgcttaggcagcgtgcgattggtctcgccgtcggtgatgtaggccccatagaaaccgtctttaatggtcacgggcttgccggtgtcagggtccgggcccagctcgcgcaagggcggtttggccgcgcctgcgctccgccgcccgtacttgggctggctgaagagctcctgggccttcgcctggtccacggtgaaaatctcatcctcggaggccagggaacgggtctcgctgctcccgtccggcttagtggcggtcaggtaggggccgtagcgaccgttgctggctgtgaccgtggctgtagcgctctgaccggtcttagcgtcactcacgctgacttgccccacctcgcggggcagggagagcagcttcagagcatcgtccaaggtcacggtctcggggttcatggacttgaacaaggaagccatcttgggcttgggctcagtggccttcttgcctgcggccttgcgctcctcagcctctttcatcgcggcgtccacctcgggggtgatcagggccaggtaggggccgaagcgccccttgcgcagctccacgcggccgccggtgctcgaatcggtgcccagcacgcgcggaccgcctgagttggtctcaatcagctcacgcgccttggcgacggtcagctcatcaggggcaagggtatcgggcagggaggcccgcttagggttgcccttgtcgtccaggtgggcgctgtcctccaggtaaggaccgtagcggcctacgcgcacctggaacccttccccgatggggatggtgttgacctggtgggcgtcaatctcacccaactgggccacctgctcctgcaggccccggtgggcctcctgcgcgttccgggcggcgccgggaccggagccgaagtagaagcgggtgagccagtcggtgcccgtctcggtaccgtgggcgatctggtccaggccgttctccatctgtgcggtgaagcggtaatccacgtattgggggaagttggtctccaacagcttaatcacggagaaggccagccaggaggggatcaaggcgcggccacgctcatagacgtacccgcgatcgataatcgtggagataatcgaagcgtaagtggatgggcggcctatttccttggcttccagggtcttgaccagggaagcttcggtgtaacgggccgggggctgggtctcatgcccctcaggctcgaccgagtcagccttgagccgctgtccctggctgaccgggggcagggagccgtcgccctcagccttgcctcccttaccgccttcagcggagaagcccatggccttcatgaagccagggaactgaatcacggtgcctgaggcttggaagatggactccccctcgctctgggtgggcgcgctcaggcgcacggtcgcggtcgatccggtggcatcagccatctgcgaggccagggtacgctgccaaatcagcgtgtagagcttcaactggtcgggcggcaaggaggaggccagctcctgcgggctgtggaagtgcgagcctgcgggacggatgcactcgtgagcctcctgggccccggcgctcttggtcacatactgcttgggaccttcgacgaggtactgcttgccgtacacctcttccacgctctggcgggcggcggcgatggcctgttgggacagagtcaccgagtcagtgcgcatataagtgatgtagccgttctcgtacaggctctgggcggcgcgcatggaggcacgtgagctcatgcccaggcggttgccggcggtctgctgcatggtcgaggtcgtgaaaggcggctgcgggcggcggcggtagggcttggtatccagcccgaccacagtgaagtcggcgtccttgagctcgccggccaggcgctcggctagggtctggtccagctggcgggcctcatccttcttggcggaggcggtcagttgtccatccgaagagaaatccctggaattgaccaggcgtttgccgcccaattccaccatgcgagcctggaagcggtcggagccggactcgctcaggtcgctggccgcggacaggtcggccactaggtcccagtagggggcgcggacgaaagcgatgcgctcgcgctcgcgctccacaattagccgcgtggccacggactgcacgcgcccggcggacaggcccggccccactttgcgccagaggacgggcgagagctcatagccgtagaggcggtccagcacgcgccgggtctcctgggccaccaccatgttcgagtccacgtcgcgcgtgtggttcaaggagtccttgatcgcctcgggggtgatctcatggaagaccatccgcttgaccggcaccttgggcttcaaagtctgcaccaggtgccaggcgatggcctcgccctcacggtcctcatcagtggccaggtaaagctcgtcggcgtccttcaaggcttgccgcaggccggagacggtcttcttcttattgtcatccacgatgtaatagggcttgaagtcgtggtccacgtcaacgccgaacttgccgaagcgctccttttgggaggttggtatctgcgagggcttggccaggtcgcggatgtgaccgaccgaagccatgaccgtgtagcccgggcccaagtaaccgctaattttcttagccttggctggcgactccacgatgaccagcttattgccgtgtgtcatggcctctcctttatatgcgcgccattcgccgccatcttacccaccagccatcgtcatctggtaaaacgcgccgggcatgtggtcgaacgttcccacgccgatgaatggataaaaaggtcaaatcaagccccggattcagcctgcggaacgctgctgaaggccagccgatcgcagacatcgcgagaaggccgctcttactctctcagcgtttttcgggcggggtcggcggggctccaagcaggccgatcttagacaggggcgaggccgtgacctgacgcatggccagaaccgagccgaaagcgagtgcggccgccgaagcgatgaaggccaacgccgaagagtaggccccataaaacgtccaacgagcacccagttcaaacccggagaccatctgccagaccaggtaaccgccgtacagggcccctaggacgcctgccgtaagcatgacggtggagacgatttgcactgaggcggagctgacgcgggtgccgggggcgtccatgcctgaagccctggtgcaggccatcatgatcagggccaaaccgccggcgatcaggatggacataatcacatcggtgggccggtgccaacgcccgtcaatcaccgagcagcccacggccagagtgaaagcgaatcccagcgccgcgcacagggcccgccaaacgcgcggcaccacgcagaccagcgccagggtcaccgtcgcggccagaatcgtgtggcccgaaggcgcggagttgcctcgcatggactcggtgttgatgaggtagggcctgggcaggaaggacttaagcaggcgaccggccaagtaagccacggccgaataggcgaccacctgggccaaaagccaccagcgcttacgcagggccgcgatcacgtaggacagcaggccgatagcgcagcagagcgcaatcgtcagcccgttgacgcgaaagatccccaagacgctctgcagaaggggcgctcgtcctatatagccggcgaaattacggtaaacctcgtcgtcatactgctgcccggccagggtacgcacacccaaccaccagaccccggccgcggccagcaggaagcaaatccccaagaccaggcagacgatccacgacgaagtgcgcggccgcacggtcagtgggtccatccgctccagctgctcagggtcctcagccgccgcccgctcgccctgggccgccaaaccttgtaagtcctgaagggtggacagtgtggccgaatcggcgccttgagccgaagacgccgtggagtcccgctccgcgaacacgtcgtcggaaccatagccgtcggtttgggcatcctgaaaagccggtccccccgccagtccggccagacccggatcaggcgagcccggagtaaacgccgacaccgaatccggtcccccaaccgggccgggaccactaccatatccctgcccgcgctgggtccccggcccttcactccaaccctgcccatgctgatctgtcatagtttcaaactctatctactcccccggtccgccgcacccccgctcccccaagaatcgcactacgtttacaggccggggccgggactatatgcgctcttccaacccccgacgctgacttgcccatctcaggcaagggctgccgcctccttgagcccacagttggggaatcgccgcgcaagcggaccacagccttatgcggacatgccagttaatgccgcccgcgaaaggatgccatagccttccaaagcggtaggtggccttcttgcggttgatgaccgccgatcttcgacaagcaggcgggacgggtgattcgatcagcggctcgtaggcgcctaaccatgcacacctacgcctggcgggactcagtagctaggacttgagtcgtcgatcttgacagtcaactcgccgttcttgatcgcgaacgttccagccaagtagccggaggcggaggacgtgtcgttgagccaattgtcgtcctcgtcgaaccggtactggtagctgatgccggtgtggatcaggtccgttttgaactcaccggtgctcaggtcgagcttgtccagtgagggcgcgctggcgacggtacgccggatattcgtgtacgccggatgcccaccgccgtcgaaggagccattggagaaatcgcaaccgctcttcctcagatcgctggaggcggtgcatgcgtcgatacgctgctgcacctgccccaggattccctgctccagggcgtccgtggcctgcggggatacataggccaccttctcggaatcgttgagtttgaccgcctcatccttgatgtacttggactggggaagatccaccgtggcgacgcccgggtagaccggaagggtgtactcgtccatggaggtgtagtgcgtcccatcactgtcgctggaggaggaccgttccgaaggcgggctgacgacctgcttgtccgtgccggccttggccaggttgaccccgatgccgttgaccgtcacggtatcgatggtcttgggcgccgccaccttgatcgaagtggtcaacgggctggcaatccgccaggagtcgaaaatcaggaagcgcttgccggaaggctccacggccagctgcttggactgcttgaccccattgaccacgtaggagattcgcacctcgtagccggcccccttcgggtccttgaccagggtcccgacctgcgcgtccttgatgcgtgagctggcgtccttgccgtaatcgttcgtgagcagcacgcgcgaatcctgctccacacccgggtccaccatctggttggcccgctggtagttgccgctggatatagccgacacataggcgttaatctgcccattcggagtgaacaccgtgttcttcaggaccgtataggcgcccgccaagatcacgatcagggcgatgatcacgccccagatgaccagggtccggcgctgtgtcttatgcgggaccgggatggcgaccgtctcttgggcccgcgcttgcgcaaccggttgagccgctaccgcgtcctcggccggagagactccaggcatggcttgctcggccccctgagcctcctccggctccagcggttgcccgcaagacaggcaaaaccgtgcgccagaatgattctcagctccgcattgggtgcaatacatggtgtccacttccgctcattgttgagagtcgcgccggtcgacggaccggtcggtcatgctcctatccccgcctgtctcagttccaccgggacagggcgcccatgaaggcggagcccgcgatgttggagaagatgatcatcagcagcacgaggatgaagaaaaccgcgatcatggcgaacagccagagccagaaagagtccaacttgcggtggttggcggagatggcgaccaagtatgagggcagcagggccatgaaggcgaggctgaggaagaagaggacgccagccacaaccgaagcgcccacgagcgaaagcaggaccagcgccaggtggaagacggcgaacgggatcacgatttgcgcgaacgtatcgtggacttgcctgaaggtgtcggcgtcaccaaagattttcctgccaaggaagacgatcaggaccagcgcgtagagcacgagagccacaccgatgaatccccggaagaaaagggagaaatagtcggaggaactgacggaaatggaccgggaggactcgcccatcatcgaaaggatggattcagcggggtacaagaccgccgaagccgccttcgcggcccagatcgtgaccaggagcgagacgatcgccgcttccacgaacatgggcacgcaggcccaccaggtaggtgtggccatgcggaggctgggcttcttcaaagcggcgaggacccagtcgaagaagagcttgaactggctggggccggtctgctgggccggagccatcccagggaccgcgccgggcatcgcgccttgggtgggaacctgcgccggctggggttgcggcgccgactggggttgctgaccggcgaaagcttgacctgcgggagcgggctggacctgaatcggagccgtctgcgcagcgatgggctggggttgcgccatgacagggacgggggaagctcccgcgctggcaggctgttggaacttttggggctgctgccggtcagcctggtcttgaacgtcccgcccttcagccgtcggctcggtggttggctccggggccgctgcgggctcgggctgagcgtccttagcgaacgatgtgccgcacttgcggcagaaattagccgaatccgggttctcggcattgcacgcggcgcataccttcattgtcccctcatctcctcgacagtcccctcccaagaccttccatcggtcttggcgattcttcaccattgaatcacgaggcgggaatatcaaaccccacggattggaccggcccagcggccgcgccgacgctgacgaccaggcataagaaaactctcacgcacccgtcagaggccacttacccttgctgcattcctgccctggggggattgggtgacgtaacgccacgtgagagctttctttattctaaccgattgcgaggattattgcagccagcgtatgtctcgccgccggctcaacccgcgaaccgctaatagttgtcgccgttcaagacggagttgttgacgaccacgtagtcgacgtgacggatgtccgtcagcttgcaaccgcccgcgtaggagatggaggactggagatcctgctcgatctcatgcagggtgtcagcgattgagccccggtagggcaccagcatctgcttaccttccacattgcggtaggcgcctttctgccgctccgaggccgagccccagtactgcttgtaggtcttgccgtcaatcgtgattgtgcctccgggcgactcgtcgtggcctgccagcagggagccgaccatcaccatcgtagcgccgaagcggatggatttggcgatgtccccgttgtagcggatgccaccgtcagcgatgatgggcttgcgcgcggccttggcgcacagccgcaccgcagccagctgccagccgccggtgccgaacccggtcttgagcttggtgatgcatgccttgcctggcccgatgcccaccttggtggcgtccgcgcccgcgttctccagctcgcgcacggcctcgggcgtgcccacattgccagcgatcacgaaagcgccaggcagggcctccttcaggtggcggatcatacggatcacatggtccgagtggccgtgcgctatatctatggtcacgtactccggggtcagaccggcggcggccagctcgtccacgaagtcatgctcgccttgcttgacccccaccgaaatcgaggcatacagccctcgctcatgcatgtcccgcacaaaaccggcgcgcgcgcccggctcaaaccggtgcatcacatagaagtatccgttggcggccaaccactgcgccaactcctcgttaatcacggtttccatgttcgccggcactacaggtatcttgaaggtgcacggcccgaacttcaccgaggtgtcagcctcggaacggctttcgatgatgcacttgttcggaatgagttgcacatcgtcgtaatcgaaaactaccgaagggatcatagcccttgccctttcgtacgtcggccaggctgcggcccaaccgtccgtggctacagcctagcaaaaggggttaccgaaaagccggccaagcgttaaaccggagccagcggccactacccaggggacagccgtcggcgcatccagtaagagagcgtgttgcacaacaccgcatgcccagaaccagagcgtttccaccggcaaatcggcggcccgcatcccctgcgcacgatcaacggcttttaccggaacaccgatgaatggttggtatacacgcggatgagctacataccaattgttaggatgccagcacttatcatcggtatcggcgcacgacaagattccagaccctaagagactgctccacactccccttcccacgccctgctcctggtggaacacagattccgaagcatcagccctccccagtcccatcgccttcatcggctggagcttaggcgagccatccccgtcaacaacctcgaacacactgactctggttcgggcgcagcgcgcattttcagcaaccacgctcacaagcgtcctgagcaagttcgcgaggatcatgccttcgtccagcaggcgcctttggaggaggcgcgagggggattgataggattaagttcgccgcttgacggctgctgcatacggtagtcacgagcgccgaaccgccgatggcagcggttatgcaggaatggaacggatgcagttaaggagaattctgaccatggacgcggatttagtggtagtaggggccgggctcttcgggctgaccgtggcccagcaggcggtggagcggaccggggcgcaggtgcagatcatcgacgtgcgcgaccacatcgggggcaacgcctactcctatatggacgaggagaccggggccgagattcataagtacggcgcccacctcttccacacctccaaccgacgtgtgtgggactacgtcaaccgtttcaccgcgttcaccgactacacccaccgggtctacaccacccaccggggcgaggtcttcccgctgccaatcaacctgggcacgatcaaccagttcttccacgcccactacacgccagcccaggctcaagcgttggtgcaggagcaagccggggaactggcgggcaccgatccagccaacttgaacgaccagggcatctccctgatcggcaggcccttatacgaggccttcatcaagaactacacggccaagcagtggcagaccgaccccagcgagttgccggcctccatcatcaagcgcctgccggtgcggttcaactacgataaccactacttcaaggacacctgggaaggcctgcccaaagacggctacacggcctggttcgagcggatgatcgacgacccccgcatcagcgtgaagctctccacggacttcttcgacgactcgcagccctggaaccgggacgccctggtgggccaggtgccagtggtctacacaggcccggtggaccgttacttcgactaccagctgggcgagctcaaatggcgcacggtcgagttcaaggagcgtcgctacaacgaggacgaccacttcggctgcccggtcatgaacttctccgacccggacgtgccctacacccgcgccatcgagttcaagaatttcaaccccgagcgctacgaccggcagtcccacgactccacggtcgtctgggaggagtactcccgcttcgccggcaagggcgacgagccttactacccgatcaacacggccgacgaccgtagcctttacaaccagtacaaggagctggcagccgcccagccccaggtcgtcttcggcggtcgcctgggcacctacgcctactacgacatgcaccaggtcatcaactccgccctggtcgccttcgacaagcaaatcgagccgctgttgggcgagtgagctccgcatcggcccgggccgccctccgttacagagtcggcacgggccagtcttagcagcaaccgtcccactcgggagaggggaagagcaccggctccgcattggcccacaggcccatgatgtcgtcgtccgggttggtcagcgcctgcacctgcaccccatccatcgtgcagtaaacggtgcggatgagtccatggaaggcttgctcaccctgatagcgctccggcagcttccagggtatcgagtccataaaatcgagcatcttggcgtgccgcgcctggtagtaatcgtgcgccggatgccgcggatcgtgggcctcgatggccagccgcatgaagagcatgaccagttccaaccgctgtgagttgactttgacaatgccagccaggtagcgcggcagactatacagttgccgcccctgcccatccttgcccacctccagggttgtgagctcgctggccggaaggctggtctcaaaggagaacgcgcctgcgtcgtagtatgtctcgatgatgagcgccagcagctcttcgcggttacgcacatagtggtacaaccccggcagagtcagccccacggcgtcggctatggtctgcatggagaccccatagctgccataataagcgatgagtttggcggcttcctgcgctatctgccgccggcgccggtcgggtgacatcctgcgatgccggttaatcgggccgtggttcgccgcattgttctccggggtgtcgagcccctcgtctgacttactcatcactattgatactagcgcaccagcccaatcgttccgggcttgaagagtggcgcgccagccgccccggcccgactgcacacatacaatccggcaaccacgcagcttgcttatttaatatttataatatataaaataaaggtgaagcatagcgcttcagagtcgtgcacagcagcacggcgtcgtactacaaaggagttctgatatgtcgcaagccagcccatcaggcgggcagatcaagtctggcccacttgaaaagtcgcgttactgcatcgctttcttcgtattcaacctcttctggatgatggccctgtccatcgtcgcctcggtgctgcttccccagcggctcaccgacatcgccccaagctccaaggtggccatctcgggtgtctttaacgccaccacggccctgacctcactggtctcgaacctgatcgtcggcaacctctccgaccgtacgcgctccatcttcggccgccgcaccccgtggatcgtctccggcggcgtcctggccggagtctccctcttcctgatgggcgttttcagcaacatctgggccatcggcatcgtgtactgcctggctatggtgggtctgaacatgatgatctcgcccgtggtggcctccctgtccgaccgcgtgccggacacgcagcgcgccaccatgtcggccttcatctccgccggcaacatggtcggcaactccctgggcaccctggtcggcgcccacttcatcacgatgcaggtccccggctggatcctctccggcatcgtcatgggcatctccggcttggtgaccatcatcatctggcccaaggagccctcggccaaggacctgccccaggtggaagcctcctggaagtccctgctcgaatccttccgcccgccccgcaacgcccccgacttctggctggctttcgccgggcgcagcctcttgcttttctcctactacatggtcctcaactaccagctcttcatcctccaggactacatgggccagtcggtcaaggattccgccgccaccatgtccaccatgtcgatggtgctgatcgtggtctccatgatcgcgtccctgggcgcaggccccatctccgacaagctcggccggcgcaaaatccccgtcgtgatcgcatccctgcttctggccatcggctacgccatgccctggatcctgcacagccccatgggcatgatcctgttcaccgctatcggcggcttcggctacggcatgtacggctcggtggaccaggcgctcaatgtggacgtactgcccaacgccagggaagccggcaaggacctcggcatcctcaacatcgccaccaccttgggtcaaatggtcggcccgctggccacctcgctcatcgtctcggtcaccaagtcctatgagctggtcttccccaccgccatcgtgttggtgatcctggcctgcttcttcatcagccgcatcaagtccgtcaagtaaggcagactttcaacaggaaaggaagtaccatgaccatcgcattggaccccggcaacaccaccagtacgattagccccctgctgcacggacagttcatcgagttcctaggtgagtgcatcgacgagggtctgtgggtcgggcccgacagcgccatccccaaccagaacggtatccgcacagacgcccttgaggccctgaaacggctggcaccacccctgctgcgctggcccggcggctgctatgccgacacctaccactggcgtgatggagttggcccccaggaccagcgccgcaccacctacaacgagaatttcggcacctatgagctggaccgccacggattcggcaccgacgaatacctgcgcctgtgcgaacaggtcggcgcccagccatgggtgaacgtgaacatgctgtccggctccgtcagcgagatgcgcgactggatggaatactgcaaccgcgccgagcctaccgacctggcgcggtcgcgggccgccaacggacatgccgaaccatacggcgtgcgctactggggtctgggcaacgagccctgggccggcggcggcacgatgacgccctccacctacatggacctctaccggctgttcgcctcctccatgccctcgttcacccattccaacgacgaacccggcatgatgtatcccatcgcctgcggaccggacggcaataagccggtggaacgggtggagtggacgcgggagttcttccgcgaactagcctccttccgccagccgcccatcagcgcctacgatttgcacttctacaactggaacatcgaccatgaggaggactcctccacacagttcgaccaggccggatggcggcgggtggtggaaggctgcctggagctggaggacatcatcgatgaacagtggggcctcatacgcgcagggctgtccgccatgccgaggccggaggtcccccaggacccgcggctggagtccgtggatctggtcatcggggaatggggcaactggcaccgagacgcctttgaggtccggcccgccctgcgccaggaggtgaccatgcgcgacgccgtgaccacggcgctgaccctggacatcctccaacgcaattgcgacaagatcagcatggcctgcaacgcgcagactatcaacgtgctcaactcgctgatcctcaccgacggcgacgccaccatcctgacgcccaattacgacgtcttcatgatgtaccaaggacatcggggcgcccaggcgatcgaaacaccccgacaggaccagcagaccggagtctacgcattcgcatcggtcaagaaccgcaagctgttggtcgacttgaccaacgccgacatggacgcggcggtggaccagacactgaccctgccggtggacgtgcgcgtggaggacatgcgaactctggtgggcgaagacccgcaccagttcaacagtaaacagaatccggaccttctgcgcgcccgcaggaacgcctttgacgccccgatcggccgcgaggtcactgcccatctggagccggcttcggtcaacaccctgaccctatcgctggcctagacggtacgcggggcgctgcacggcgcccctaggatacggctgagggccgccccccggaacttggggggcggccctcaacatgcattaagaaccacagtctctcgttaccgactcaaccgaaccggaaccgaggagaaccggactcaggctcaggcgtgccagacgtccttgccgccgtcctgggcggccttcacgtcggcgtccagggaggcctcgtcggcctcgaccttgccggtgatgtaatcctcgaccagctggtgggcctcgttgtcctcgtgctgcacggcaggggacttcatgaagtaggaggagggagccaggaccggacccgccaggtggcggtccaaggcaatcttggcggcgcgcaccgcatcaatcacgataccggcggagttaggcgaatcccagacctccagcttgtactccaggttcagcggcacatcgccgaaagtggtgccttccaggcgcacgaacgcgaacttgcggtcgtccagccaggccacgtagtccgaggggccgatatggacgttgtgggcgtccatctcgtggggcacgatcgaagtgacggcgcgggtcttggagaccttcttggactccaggcgggtgcgctgcagcatgttcatgaagtccatgttgccgcccacgttcagctggtaggtgcgatccaggcgcacgccgcgatcctcgaacagacgggccatgacgcggtgggtgatggtagcgcccacctggctcttgatgtcgtcgccgatgatcggcaggccggcatcgcggaacttctgcgcccattccgggtcggaggcgatgaagaccggcaggcagttgacgaacgcgcagccagcgtcgatcgcggcctgggcgtaagccttgtcggcctgctcggagccgaccggcaggtaggagaccaggacgtccaccttcttgtcgcgcagaacctgggccacgtccaccggctgggcgtcggattcctcgatcatctgcttgtagtactcgcccaggccgtcgccggtgggcccgcggagcacctcaacgccctggttgggcacatcgcagaacttgtaggtgttgttctgggaggcgtaaatcgcctcggacaggtccttgcccaccttcttggcatccacgtcgaacgcggtgacgaattcgacgtcgcggatgcggtagccgccaaagttggcgtgcataatgcccggaatcttcgcgtcatccttggcgtccttgtaatattcgactccctgcaccagcgacgaagcgcaattgccaacgccagctatagctacacggatactcatacaaaactcctctgataataaccaataccaattccagcatagcctttggtggcgagaggcgaccgctgtgggggcaaatgcttcacagcggcaacgcaaggggtgacgggcgcgtaaacgtactaaaagtatggaaccttactctttgagcggactcttgacatagccagagattagcctggttggcatgatatttgagaaccggtcatcgttttccgcgcccagaccgcccaggaaggcccgttcggcctcctccgcgggccgcccaggcgcaggcggcggaagggccgcgactttccgcccatccgggggccccaagctgcgcgccccccgcgggaccgaccccatcacggaagcgggcaagagccgccacggggccaaacgcaggggcggctccgggccagccaagacgcccaagctggggcgcgacggcaaaccccgcaaacgtcacctgatcctcaagtggaccttaggcatcctgggattcctgctcctggccggggtggccgccttcgcctacctgtacctgaccaccgaagtggtgccgccggagaagcaggccctggcgcagaaaacgaccgtctactatgcggacggcgtgacgccggtgggctccttcgcggagcaaaaccgcgaaatcatcccctgctcgaccctgcccaagcacatgagcaacgcgatcgtggcctcggaaaaccgctccttctactccgataacggcatcgacctgaagggcatcggccgcgccctgttcaacaacgtgaccaagggcacccgccagggcggctccaccatcacccagcagtacgccgagcgctactatctgggcgaaaccacctcctacaccggcaaactgcgggaggccatgctctcgcttaagatcgcgcaaaccgaggataaagacacggtcttgtgcaattacatgaacacgatctacctagggcgcggcgcctacggcatccaagcggcggcccaggcctactacggcaaggacgccaaggacatgaccttgcccgaatcggccatgctggcgggcatcatcccagcgcccaccacctgggatccggcggtcaacccccagcaggcgcagtcccgctacaagcgcgtgctaggcatcatgcaagaggatggctatatctcggccaaagacaagagcgaagccctgaaagcgccgcccaagaccatcgactactcgccgcagaacgtctaccaggggcccaacggctacctgctgcgcatggtgcgcacggagttggctggcggcaaaaaagcgcccttcaccgctgacgagctcgacaccggcggctacaagatcatcaccacaatcgacaagagcaagcaggacctcatgtaccaggtggcctcgccttcagtggagggcaagcggctgccggacggcttgcaggtgggcggcatgtccgtcaaccccaaggacggctccatcatctccctctacgccggtgacgattaccttaagcaccagctgaataacgtgagccaggcccgtttccaggtgggctccacgatgaaagtgttcacgctgctgggggccatccaatcgggcgtgaacctgaacacggtctttaacggcaattcgccgcgcaccttcaactccgtgggcaaatccgtggccaacgcggagggcatcagctacggttacgtgaacctgtattcggcgctggcgaactcggtcaacaccgtcttcatggacctgaacgagcatgtgacctcacaaaagaccgcgcaggtggcgcacgcagccggcatcgaaggcaagatcgacgacaccaccaccttcgacgcgctgggcgtggacgcgctgaccgactgggacctgacccagggctaccagaccatcgccaacgggggcaagaaaatacccttgcacctggtcagccaagtcaaagacactaaagaccagcagctctacacagcctccaaccagggcgagcaggtcttcaacgccgagcaggtggccctcctgcagaaggccatgacgggcaccgtgcagtacggcaccggcacccaggcgcgcgcggtgggtaagaccatcgccgccaagaccggcaccgctaacgacgacaccgcggcctctatggccggcttcacgccctccgtgctgaccaccttcggaatctggcagcccggaccggacggttcggcacagaaggtcccgaacttcgccggctacccgcatggttccggctaccccacctacctgttcacccagtacatgaagcaggccacagccggcatggccgacgagaaattccccgtcgctaaggacgtaggcaaggtgggcggtcccgatggcacttggggcacaggccgcgcctcatacagctacggctaccagcgctcctacggaaacaccaacggttatggcaatggctacaagaattacaactacaactacaactacaacaacacccagggtggcacccaaaccaccccgaaccagcaaaccaacccaggccagcaatccacccagccgcaaacccagccaaactccggtcagtaagtccaacagccgcgggttgatcaaccgctcgtcgggggaaggatgcggctcgtgcttcagcagatgacctatttcgtggccgtcgtagaagagggcacctttttgcgagccgccgagcgttgcaacatctcccaatcggccatttcccagcagatcaaagccctggaggggaggctgggtgtaccgctcctacggagatccggccgcggtttcgagctgaccgaggccggtgaatatttctacaaccgcagccgctccctcttgcgctcggtggacacgctgaccaagcgaacccgcgagattggcgaccaggcccatagctcgctggccgtcggctacctccatctttcggctcgactgaattcctgcaagcggtagccgccttctcccggcggtttccccgcatcgggctggacatcagcggcggcagccatggacgcctctaccagttgctgaccggaggccaggcggacctggtcttcagcgaccagcgacgggacctgtcccgcaatttcgtcaacttgtacctgacttccagccgactcgtggccgtcgtggcgaggcagggccggcagcgggactcgcggcaatccccacagcgggccacaggcagcgcggacgtgcgcgaactggccgacctgcccgtcatcctgctggccagcgacgatcaacgctcggccgaggaggattttcaccacagcgccctgggactgaccagccggtgcatcttcgcaagctcccgggaggaggcgcagctgctgatggcggccaaccagggctacctgctgatggacgagggcgaaagcgcgcaggtggatccacaggtgggacgggccctggctttgacgcggcagggggagcccctggtgcgcaagtattacgccttctggagccgagataactcgggttattatgtggaggccttcgcccagctgctcaaatcccagtttcaataaggcgcagagcgctcctcgccgcggttgcggcgatatcagcaagccctggccaccgctggctcccctcgtctgacgggcgggcgacatataagtaaaacttatcaatcaggcccataatcgagattgtttcgaccctctccaagccttagcgtaacagcatgaacgccggtcaaccagaccggccgccagcgcgaaaggagacggcccatgcccatcaccgacttcgcccatgactttcatgagaggatgttcccgggctaccggtccgactttctgcggaccgacccggagttcatcgagcgattcggcagcttcgccttcgaccaagtgatccaccagagcgacctgcccgaccccacccggttcatagccatcctcgccagcctcatcggatgccagggcatcgacgagttcagagccatgattccggccgcgctgaacttcggcctaagcccggtccagctcaaggaggtggtctaccaggccgtggcctacctgggcatcggccgggtcttccccttcctgaaggccgccaaccaggccctgtccgaggccggcgtcgagctgcccttggagccgcaggcaagcacgaccagcgacgagggcagccgcctccaggccggcgaacgggcccaggtggacattttcggcgaggatatgcgcggattcgcccaatccgggcccgaggacagcaggcagatgaactactggctgaccagcaactgctttggcgactactacagccgatcagggctgagccgccaggagcgggagatgatcaccttctgcttcctggcggcccagggcggggtcgaaccgcaactgacctcccacgcggtggccaacctgcgcatcggcaacgacaaggacttccttatcgccgccatctaccagctcctgcccttcatcggctaccctcgctgccttaacgccctgcgctgcctgcgcaaggcggtcgatcaacggcagcccagccggaccgaccactagggcgcacccacttcgataagtatccgtctcagcaaggagagcaatatgaacaagcaaacatggctcattaccggcgtcaactccggtttcgggctggaactgacccgacagctactggctgcgggccacaaggcggtcggcaccatccgccgcgaatccccggccgtggccgagctcaaggcccagtaccccgacaccctggagacgccgaacctggatgtgaccgacgtggaggccgtccaccgagtggtgggcgccgccttcgagcgccagggccgcgtcgacgtggtggttaacaacgccggctacgggctctttggcgcggccgaggagctgagcgaccagcaggtggagcacatcatcgccaccaacctgcttggctccatccaggtcatccgcaccgccctgccgtacttacgcaggcagggcgcgggcatcatcgtgcagatatcctcttacggcgggcaggtggcctacccaggcaactcgatgtatcacgccactaagttcggcattgaggggttcgtggagtcggtggcccaggaggtcaagcccttcggcatccgcaccatgatcgtggagcccggtggcgcccggaccgaattccgctacgggagcgcccaggtggcccagctgatgcccgagtacgacggccccacgcacgccttcctgaagatgctcgacccggctaacggcctggcccccggcgaccccgccgagatggccgcccgcatcatcgagtgcgccgccgaccccgagaccccccctgcatgtcgtattaggctccgaggccctgcgcaacgccatccagcggcttgaggaccgcctgggcgaataccgcagcgagaccgacctggcctgctccaccgacatcgacgagtgaataaatttggcccggccagccgtcgggccatagatacccgccaccgcttgcgtaggccagtacggccgccgcaaccggtggcggcgcgatagcggccaccgacgaacggggggctattggaagagggagacgccccggcgagcgacgcagaaggcgttgcccagccaagtgtggcgggagttgggccagaccgcgcccagtcggggagcgttctggctcatccagatgctaggcacgcggccgtcggccgaacgcgatccgagcaggttgaaaccgttctttttgaccagccaatccgggtgctgggtggcgatggccaggccttcctccagggtgagcggaaggcagtcgtcggagtcgatcagcttgcgggccacgtccggttcacgattggtgtagcggctgccagtgtggggctcaaccacgatgtagaagggtccttcgggcggctcgaacccatcctggggcaggaaggaagcgatgtcccgggggggcatggtggtgaagccggccatgcgccctatcgaggtacgggcaatcagggattcgggggtgaccagctcgcgtgtgggcaccagcaggatcttgtcgcccaaatccacctgctccaagacgctgatgagaggagcggccagggagcggaatgccgccgcgctcaaatcggcgacatccgggtatcccagggccacgatgcggtccagctggcggacggcctcctgcgaagaagtagtcatgcccccagtctaattcacggcgttaccgcgcgccgcgccatcaatcgtcttgctggatactgtgcgcatagtgatagtcatgcctgctaagaacgtgtgcatcttggatcaggatctgcatctcgtgcgggcggcgaccaagcgagcggggagcctgtccggctccgtcatggcagggctcaggctctacccgcgctcccagaaggacggcggagcccagtctggaagcggtcgagctggaggtcagcgaccacgggcgcaccgtccgcaagcgcttcgtcggccgccgactttcccgcttcgaccagcaggcggaccgccggcagagcgtcacggagattttcaccttccgcaagggcaagtatgtgctccaccaacgttcaatgttgctgtggcgaaccgccagcgaccgggtcggcgaccagtggaccagccccgcccccaaccagtcggtctcccgctccatggccatattcgacaccctgagcgaactgaccgcccaacttcccccggccctggccgccgaagtcgccgccgccgctgaaacagggcccatcgaagacctcgatatctgatcagaccacccaaaaacctgcgccaggcggcccgtgagcgaaaacagctgacgggacgcctggacgcaggcttattggagcgcatttgggtcagtgttgaccgtagacgttctggtagcggtcgttgagcttgtcgatgtcggactggtcgatctcgatgattccgcccaactggcgggcggcccacatggtatgcgccacctcctccgtcatcgcagcggccttcacggccgactcagcgtcctcaccaatcgtgaaaggcccatggttctgcatcagcacagccggcgagttggggtagcgtttcaaggtctcgaccacgccctcgccaatcgcctccgaaccgatcaagcggaaggggccgaccggcacaggaccgccgaactcgtcacccatcatagtcaggccacagggaatgttctgccccgtcgccgcccaagcggtcgcatacgtggaatgcgtatggaccaccccgtacacatccggcatattacggtagatatacgcatgcgaagcggtgtccgaactgggcgcttcagccccatccaccgggttcccttccaaatcagtgaccaccatcgaggccggcgtcagatactcataacgcacgccagacggcttaatcaccatcaaatcggcggaatgcagcctctgcgagacgttgcccgcggtccacaccaccagattccacttcaacaactgctcatgcagggtcgccacctgctcacgcaccagcttgacctcagcgcgcacctcaggcgaaaaatcagccaatgtagccataacatgaactccttatcattcgatgcttgaaccctacaggctctccaggtccttacccttggtctcctgggcgaacaggtaggtaaccgcgccgatgaccaggcagacaccgaagaaggtgaaggccttggtgatgaccgagatgtcgatgtgctgggcaacgtagctgccgcccaccagggcgcccatgacgatcgggccgacgatcttggcgatggcgccaatgccgtagcccaaaccaaggccggtggagcgcacgtcgttggggaactgctcgccgccaaaggcgttcagaatgccgaaaacgccatccgcgaaggtcatgatgatcaacacggcgatgtagaactgccaacccgagctatggaagaatgcggcgtagaagcagccggccgcgccaatgatgccgaacgagaacatggtccagcgacggccgatcacgtcggccaaccaagcggagccgaagcggccgatgcaatccgccacggagacgcccatgaacaggtaggcgaccatctgggtggagaagccgaaggcgtccttcatcagggtctggccccaggactggatggcgaaggagccaaggatgaagcagaaggaaccgagcgagatgatgaccagcggcttcaggctcttggagaagagcagggagtacgaagccttcttctcctccttgacctcgggcagggcgccgacctcgctggccggcatctccagggcccaggccagggcctcgcgggccttgtcatccttgccgatggactggtagaagcgcggggactccggcacggtggccaaccagaagaggaggaggaccgggatgactcccaaggccaccagcaagcgccagttgccgccaatcagggactgcgccaccgaacccagcaggaggcccatggggatgaagaccgaagccaaaccggagagcacgccccgctgcttggcgggcacgaactcctggacgtaagggatggagatgatattcaggccacccacgccgatgcccacgcccacgcgcaggatggccaggaggacccaggcgccgtccggcaggaagaccgagagggcggtgaatatcacgaagcaaatcacgcaccactggaaggcgtgcttgcggccgaacttgtcggacaggcgaccccagacgatggagccaatgaccgtgcccaaaccggagcaggccaggatgatgcccaccgaagtgccggtcagatgccaggcggaggtgagcagggaaacgacgaagccgatcaggaacatgtcgaagaactccgagatgttaccggcgatggccaggccgataatggatttctggtgcccggtcaggggccgggagtcgatcagctcataggctgtctgctggggtcgcgccacggaagcgttggaatcactcattattgcactctttcaaggttgctggacagggaaactgcgccctagggcagtcagcggttgatgtcgtcgcccatggggatgtcaagctcctcggggcgcatgcgggtcaggtcgcccatgtgcgtcagggcgaactcggcggccttctggccccatttgacgccgcactccacgtcgccggagaggaagccgtgcagggtggcggagacgaaggaatcgccggcgccgggacggtccaccacaggtacggtggtcgttgtgtacttgtgcagcccgttcttgtcgcgcaagtaggggccgtcgagatggttagtggagaccacgtactcgttgccgaaacgctggtagagctgttccgccacctcctcgccggtgccttcgatgccgaagaccgccttggcgtccttgatggagcagaagaggatccgcgccttctcggcgatgggctccaggaccttgcgggcttggtcgccggaccagagcttggagcggaagttgacgtccagggcgacgtcgacgcccctcttctccgcctcgtcggcggcgaagctgaccacggaggcggtcgtgtcggtcagggccgcggtgatgccggtcaggaagaccaaacgcgtgtccaggatcttatcccagtcgtactcgtcgatgccggtggtgcggaagggcgtgtactcgcggtcgtagatgacgttggccggcatcggaggctcgccgggctccatgaagtagagggcgatgcggcttgtgggcttgcgcaccatcgtggacaggtccacgccgaccgagcggtactcgctgagcacatactcgcccagatcgccttcgggcagggaggaggtccacaaggtcttgcgcttgagctcagacagcaaaccggccacgttggcctcagagcaagcggggttcatgcgcacggagcgggcgttcatcaagcgttcgccgcggttgacggtcagtcggatctggccctcgccgatggtcgacaaatcataggtaggtgttggcattgcttctcctatttaaaacaagcggatgcagttcgcgggaccgctcgtcgtagagccggtccggcaggcataggttggggggagccggtgcgggaggcccatctttgataccacccgcgccgggacctgcatattcaattcggtattcgatattcggtattcagtgttcgtttgttgtcggttgcgcgccgccgtagcgctcacgcccgcctgggaatcacctcgatgccagccgcctcaagccaggtcgataccttgctccgggcgtccgtcacgatgcggtccgcgttgggatcgtcgtcgttccacatctcgatcataatgcgacccgaccaatgctgcctggccaactcggcgaacgctgtcgggaaatcggcgctgccttcgcccatgggcacccggcgaggctcgcccggacgcacatccttgacatggatggccagcatacggccctgcccggccttgagctcggagacggcatccaaccgctgctcgtagaggttgccgatgtccgggtacatggtcagccaggaggaacccacctgatcgcaaatctccaaccccttggagatggaagtgatgtcgttgccgtccacgttctcgatgcccagcatcacgcccgcctgggccgcgtactgcgcagcctgggccagggtatcgaggtagcggtctcgctgaccggcgtccggctcctcgtagtaggcgtagtagccggccacttggatgactgggatgccggcctcatgggagaggtcgatggccttgcggaagatgtcggcggcttcccgccgcacctgggggtcggccgagcctgggccgaccttgcgatggcaggacaggcacatgccgccgatttggacgccctggcggtccgcggccgcgcggaaggcacgggcctgggctggggtccagtccaggcgggccatgcgttcggcgctctcatccaccgacaagtccatgaaagagaaaccatcgcgggcggcctgggccatgaagaggccccaatcgctcgggtcggccacggccttcagggctttctcatagatgccgagggtaacggatccggcgctcattgggcccagacctgatctatggtatcgcttagctcggtggcggcggccagcggatcgtccgcttggacgatgccacggccggagatgatgacgcccacgggctcacccttgaagaaggggatgtccttggctttgacgccgccggtgatggtgaccttgaagcccatatcgtggagctcgcggatgcgccgcttgtcatcctcgccccaggtgagcttgccagccgcctcggcgtcgcgggagcgatggacgatgacctgggtggcacccagacgccgccattgccgggcttgctcggggtcgtacttctcccccagctcaatctggacttcgccgccgaactcgttggcgaccttgaccacctgctcgactgtggtcatgctggcgccggccacgaccgagacccagctggccccagcctcgaagcaagcccgggagatgaccgctccggcctcggcgatgcgcacatcggccaggatggtcttatcggggtagagggcgcgaatctcgcgaaccgccctgagcccttcggcgatgatcagcacggtgccgcattcgatcacgtcgattttggaaatcgccgcgttaagcggacgcagggcggacggcatgtcgaaggtgtcgagcgctatctgcagctggggacgctcaagttgctccgccatgggtctcatgcctccttacgcagggtgaagaagcgctgagcgttggtcatcagcaacttgtcgacgtatgcggggtcgaagccttcggcgatcatgcgggggccgtcgacggcgggattgtagtccacgccgctgaccgagccatagaccttctggtaggagcgcttgccggagtcagtgcccaggaggatgcggtcttcgaaaccgtccttcttgaaggcggccagctccatgaagcggttggagtcgggctggtacttgatgcggttggtgccgtcgatctccaggtagacgcccaggtcgaggatctgctccaggtagtagacatcggcgttgcgctggatgtggccgatggcgatctggtcggcgggcacgcccatgtcgatcagggtctgggcctgctcaaggccgcaagtgccataggtggtgtgggtgttgatgggggcgccggtctcgatggaggccatggcggccgcttccatgcacttatgctcgaagggcgtgatctcgccatacgcggtcccgaccttgatgacgccggccttgtagggggagcgctcgacgatggggccggagtaatcgttctggtcaatgccctcgcggatgtcggcgatcacgagctcggcgatctggtcgggggtgtaacggttgatccagtgcgactgagtctccaggtagacatgctcgcggtggaaaccggtggccgcgatgacctgcaggtggtccacggaacgggccacctcggacagcttgcggggatcacgaccgcagttgatcgggcacatatcgacgaccgtgccgccattcttgctccaattcagggaggcctgcgcgaagtagccagcctcggtctcggccttctcgaccgaatccaactggtggtcgccatcgatgtagacctcgccagcgcccacgcggatcaggtggtcgtggctgtcgacgacaccgagggttgaaggatccacgtcaccgaggattgtacgtgcgattgccatgtgaactcctttgttgtgcttggtctgccaccatgccgcggacccaggtaggcgctcgcggccttggtagttgtaaacctaggggagttctagcaaaaagtatagcttcgttatgaacatatgctcagaaagtggaaatcatcattcgatcccatgcgagaataaacattgtttcgagcaatatgtcagaacaaacatgaaacaaatacgcatcagttgggtcatgatataacatgaacatatgttcaacaatgacgcctcgctgacatcatcggacgaacgccagcgaatctccgagatcctcgacgttgcacgcatgtattaccagcgaaacatgacccaactgcaaatcgccaagaccgtgggctactccaggcccacagtctcacgcatgctccaggaggccctgggccgtggaatcgtccgcatcaccatctccgaccccctggagcgcctgcagaatctggaatcgcagctggtgagccggtttggcctgatgtacgcgcgggtggccgagcctcccgccggtggagggcccatcgacgtaatcccccgctgcgccgcctccatcctggtcgagcacgcctcgtcggactcactggtcaccgtctccaacggacgggcggtggccgccacggtgagggaggtgcccgtccaggattggaagaagagcaccgtggcccagatgatcgggtccctctcgcccgcgaaccccatgaccgattcgccggagatctgccgcatgctggcgcaacgcctcggcggctcttacaccaccctgcccgtgccgatgatcctttcctcagcgccgatggccagggccatgctcaaggagaagcagatcgccgccaccctggccctaggaggacgggcggatgcggccatcgtcggcgtgggagccgtaaacaacggacgcagcgggcacatcttcaccgactacgaagacgccggcgtcgtcgaggaaatcacctccctgggcgcggtcggccacatctgcgggcatcacatcgacgattacggacggcatatccgcaccagcttatgcgaccggaccgtgtcgatagatttcaaccggctcaagcgcataccgctggtcatcggtgtggcttgggggcatgccaaggttcgggccatccgggcctgcatgcgcggcggcctcatctccgccctggccaccgaccgctccaccgccgaagaaatcctcgccctggataacaccggcaagaccgccgacgatgagcgatgaacccggcgggagaacaacgagaacccgccgcgcgtcctacacctcgctgcggcctgtgagagcacggcccagggtgatttcgtcggcgtattccaagtcggaaccgaccggcaacccggaggccaaacgggtgagtttgaggtcgagcggccccagcaggcggctcagataggtggtggttgcctcaccctcgatgttggggtccagggccatgatgacctctttgacctcgtcgctcttcaaacgctccaggaggccaggaatgcgcaggtccgaaggcgccacgtcggccatagggttgatcgcgccgcccagcacatggtacaggccccggtactcgcgggtgcgctcgatgctcatcacatccttgggttcctccaccacgcagatgatggagcggtcgcggcgggggtcctgacagatggggcacgggctgacctcgcacacgttcccgcaaatttcgcagaaacgcactttcgctttggcggtcatgaccgcgtcagccagctcctgggcctggctttcatccgctcccaggatgtagaaagcgatgcgttgggcgcccttgggcccaatccctggaaggcgcgcgaaagcgtcgatcaggtcctggatcgctccgtcatatgccactgccattactgctcaaatccttgctgccgcttgcgtttgttaatgttcagagggttctttggatcgtctgcgctcaaatcctccacttttttaacatcgaacatcttggccagctctttcggccccatcagcgattcctcgccctgcctggcgtcattgagggaatactcatcctcgtcaggaggcacctgcgggtcggactggggacgatccggcggcacgaagctcccgtgatcgccgtcggggcccggcgaggcaggggtgtccgccacgggcgcggcgggcgcctcgaccggcgctgactgcggcgcgtcctcgataggcgttggatggtcgacgaccctcgacgtctcggccgaggcctccgctgcttgagctgagtcttgccttaggaccggggtctgatccggggcttgggtctggactgaggcagggttcgatgctaagtgactggcccagggatcgtcctggtcgctgaggtcgggcaagcccatcttgcgggccttgcgctcggcctcagcctcctcttggtcttggctctgcgacccgtcagcaccgccgtgaggccctaaatccacggtgggtgacgaaggggtggcccacgggtcatcatcatccagctcgtccggcctgacatacgactcggtcgaagcgaaaccagcggcagacaagggcgacgacccctggatggggccgccggaagggcctgcaccctgatctaccggctcgctgcccgacgcattacggccagcgtccgaacccggaccactggcgtggtgagcgtcggagtcggaggcgtctccagcggactccccttcctgcgcggaaccctggcttgagtgctgctggcctctggcatggggctgcccggcggcctcactagctgtgtggggagcgacgccgacgcccaggttcatcgcggacatgttggtccgggccagggctatccgcttcttcacttcagagcggcgctcggggctcatcctggccaccgactccaccttctcaccgtttgcggccacgcccgacggggcgatcatcgtgtcggggccaaactcctggcgggcccggaccatcacgatgttgggcaccttggtctcaccgtccaccgctcgtgcggcgacggccagagcgaaagcgtgctggctcaacggctggtcgaaggtcaatgccaggaccaagcgccctttcggatttcgacgcagggccacccggggcactttctcccgaaccacgtattccttgacgccatcaggcagggccgctactagagcgtcccagcgctggtcaacgctctgatccgcgtggccggagggctgcgcctgaacctggggcgcgggccgcggtgcgccggattgcgtcggcccctgggccaccggacttggcccaggcgcttgctcttgcctgccatcgccccgaggcgcagatgggttctgccgtttcgccccgatgaagccagcgccagcaggagccccaaccatggaagtgcccgcccgcccatcactagccgcggtaggcgccagctccgagtccggcaccaagaggcgggccgccagcagctccaacctcatacgtggcgaaattgccccagacatcgaagccaacgcgtcgtcgatgatgtcggctatccgtgtgagcctgcccatgccgagggccttggcctgccgctccatgtcgccggttccctcgacgcccgcatcctcgctcagcacgccttcggccttggccccagccaaggtcaggaccagaaggtcgcgcacccgttgcaggaggtcctcaacgaagcgcttgggctcgaacccaccaatcacaacatgctgtacaaccccatagagcttgggaccgtccccctcgatgacagcgtcgatggcctcaccgatcagactctcgggcgtgtaccccaggagcgtcacggccgcgtcgtaggtgatttcgccctggtcggcgcccaccatcagctggtcgagtacagagagggtgtcgcgcaccgaaccgcccccggcccgcatggccaacttgagcacgccaggctcggcttcgatcttctcatcctcgcaaatgctctccagatacggctccatgacctcttggggcaccaggcggaaggggtagtggtgggtgcgggagcggatggtcgagatgaccttctccggctcggtggtggcgaagatgaacatcacatgctcggggggctcctccacgatcttgagcagggcgttgaatccttgctgagtgaccatgtgggcctcatcgaggatgaaaatcttgtagcggtcgcgcaccggggcgaatccggccctctcacgcagttcgcgcgcgtcatctaccccgttgtggctggccgcgtcgatctccaccacgtcgatggagcctggaccgccggtcgccaggtcccggcagctatcgcactcgccgcacggatggctggtgggtcccttgacgcagttgacgccgcgggcgaagatgcgggcactggaggtcttaccgcacccccggggcccggagaacaagtaggcgtgggtcagctttcccgcatccaaggcgcgggaaagggggacggtgacctgcttctggccgattaccccgtcaaaggtgtccgggcgataccggcgatacagtgctagtgccatagttctaaggtatccatttcttgcgacacaggccaacgcccctcccacaggtccggcggcgccggcccattgccccaagggcgcgttcacgggcagtcacgcggcccggccctggcctctttggacacttgcgtggcgaaaggcacctgggtggccacttccacgcgcacgagcgcatcctgcccttccacctggcaggaggccaagctggccttgttggccgtcgctactgtagtcgcagcggagcatggcgcgcccgaaccttcgtccagggcggacgcggccgccagggccgaggcatcggcggcggtcctcgcccgcgactggcagaccaggatgttgcccagcgtagccactaaaaccaaccccagcgccacgatggcgaccagcatgacccccatcgcggtaccggagccccggtcggcccgacgcaggacggcgggcaggcggccggttgggaggttggcgctactcatcgagcatcgccaccgctgagccgttgacccgtccgggcaggacgcccagcggggtggacaggaccgggcaggagacggataccttgacctgctggtcggaacgctccaaggaggtcgccgccgaacctcccgccaccctgctggccacgcctgagggatccccctcgccccggtggatgaccacctcccgggcagccgaccgggccgcgtcctggcagctcagcgagacgcagaccgtctgggtgaggcctagaaggagggcggcgacagccacgaccgccggcaggaccaccgcgaactccgctgtcaccgacccgctgtctccacggctcaaccacgcccggacccgccgccaacctcccaggagaccaaagcgtccgtcgggcggccgccgccagcccagccaggtagggcgaagccgctcgaaagctcccgaccgcaaccggtccatcatcaggccacactgagcgcccgcttgaccaaagccagcagaagctcacgagcggtgccggatttgaggatggccagaaggagcccagcgaatgctgtggcggcgatcaggacgaccgcgtactcggcggtggcggcgccggactcaggttcggcagccaacgcatggacgcgggattggagggagcagaccagccgtagggccttgtccgagagccggcgacccagcctgcgcagcgggatggagatcctgcgcaagggtcggacgcaggccaggtaaaccgtcatagcgacgaagcggagacccgcccagaccgtttcccgagccgcttgctcacgatgcatggggacgagggtcatggctggttgggttgcgatggcaactgggatgaaatgcgagactgacatgtgcaatacctttccgtttgcctgccgcgatgcggcagatggttcactccgattcctccggcccgggcgggccacgcggtccgccgacgcctcccccaggtgcagcggcccgacagggcctctcgttgcggggtgcttccaactgtgcccctcggatgctttcggtcgaagccgtaccatctcatgtggtcgaacgtggtacttgtggataagtgccacgaaccggggcggggcggccccacaggcgcatcagaaagacaagcctccagcgaaagaagcgatgcacggcaggaccccaatcaagatgaaggccggaaggatgcacaggccggttggcaggaggattttgacggtcagcccggctgaggcctcgtccaaacgccgacgctgggtctggtccacctgctctatggtggtttcgatccgccccagcggcgagacgccatgcctccaggaggactccaggcagtcccgcatgagcgcgaaccggggcccatagcgggggtgggagcaggcctgggtccaggcggaataccagtcggtcccctggttgagcagacgggccacctgcttcagaggggtacccaggcccggctggaccaccgctccaatccggtccaaggcgtggggcactgacgccccctgccgcacgcagaccgccagcatctccagcaaaagcgtcaacggtatgtccagattccgctccgcagcgtcgagctcgtccaaggccctagacgggcgggataggaccaagcccagggaggtggagccgaaggcggcgcacaagacggcggacatgggaaggctcaccatctcactgcgccgccttatcgtccaagtccctcagcagggcccgcatccagagcagacccagcaggtagcatgaccctcccaaagccagacagagcgtgccggcccccggtttgagcaggaaggacaggggacgggcgcccaggagggaaccgaaggccagcgtcagcaagggcaaggcggtcaggagcttaaccgtggccttaggcatggcgaacgcagccgccttggcctgggccagtcgggccatcctgcgataagccgacccaaccgcctccaggcaacgcgaggcttcgcagcctaaggtcacgctcaaccggcaggcgacgaccagcgcataagcgaccgcctcgacctggtcgttcgtctcctgaggaaggcggcgctcatctaacatggcgcgagcccgggcatagctgaccctgcgcgtagcgaaggaccgcccggcctgttcctcgaaggcgcccaccagaccaccgccgttgcgcaggtaagcggagagggaggagatgaccgccgccaagccaatgcgaaccagccctccctgcccactggcgcccaggcccatcagccgggagcaggaggcgctccgggcgggctgacgcagggccagggccagaacggtccacgctgcggcccagaagggcgctaatgagcccatcatcgcgctcgcccgacttgcatgcgaatcggactggtctgcgcgggcggatggggacgcggacgggccatgcctcgcgcagggcctgacgacggaccagcgggcggtggcgcggacgaacgaaccatttcctgcgcctcagccgagtgggccggcccagccgccttctccaaaccaggcagcccaactccgttaggcactttcgtcacctgacgcaaggtcgccggattgcccggacactgacccgtcggcccgaccccctcaatcccccaacgccgggcgaaaccgggccatagagggctatagagggccggcccgccgccatcccagacgcacactggccgcccccgcaaacgcccacgcccatcgagacccagcaggccgatctgggctatgcgtcggtgactcccgacgcgctccagatggatgaccgcgtcgaaagccccctcaaccagggcagcgagcgccagcgggtccaaccccgccaacaagcccagggtggccaagcgcgcgggcacccgccccacactgtcagcgtggagggtgaccatgccgccgtggtggccggagttgaaggcgcgcagcaggtcggccacctcctccccccggcattcccctaagacgattcggtcaggccgcatccgcagcgtggccttgatcagctccggcagccccaccgcgcccgccccctccacattcgcttcacgcaccgccatggagacgtggtctccatggccctgcaaagcccccaattcgcgcacctcctccacagacacgatccgctcgtccgacccgcactggcccaggagcgccttgaggagcgtggtcttacccgagccggtgcccccggtgatcatcaacgtggccctcccagccaccagcgccttgagcacgcgcacccagccggcgggacacagcccacccgccgccagcccctccaggccaggtcgggcccgatcaggcaggcggatggagatggaagcgcccgaagccacaagcggcgggataaccgcgtggacacgcaccccgccctccgtggaagcgtcggcgatggggcaggaatcgtccaagcgcttgcctaactgggagcacagttgaaccgcgtactcgcgcaccatagcgggcccagtgaagcccggccgcacccgtcgctcctgcatgcccgagcccgtgtccgcccagacccgcccgtcgccggtgaccgcgatatccgtgaccgcagggtcagcggccagcgcctgcaagtagccgaacgccagaccccggtcggcgtccgtccccgccgtccgtcttgccctcatgtccaaacccccttgggggagccgagcccagccaaggcttctgcccgatcccctatagcagccaagggcttgcggtaggagcgggggatgcgctcgacgcccaagccctctaatatgcccgtcgccagcttggctcgcggcttgaggaccgccagcagcggccgccccaagaagtcctcggcctccccctgactgaccggcggcgcgcccctcacccctcgcggcgccacgccaaccacttccacagggccgctggacccctcctcgacgcgccccagcagggcccttgtgcgggccacgcccagcacgctcagctcagcgagcaccaggcgaggctgcccagccagggcctccaacccctccagcccttgccctccggcgccgtcgaccaacagcaagtcggaccgggcgcccatcgccgccagggccgcatccagatcccaagcctgcggcggcgcacccttccaagggtcggaactcagcacggcgattccctcccacttaggcagctcgtgggtcagcgcgtccgggtccatccgccctagcggcgcctccagctcgctcaagcgcaagcccggatcggtctccagccccagcaatacatccatgccgccggcggcgagatccgcgtccacaatcgcgcagcgccagccccgcccagccagaatcttggcgcacagggccaagcaggtggacaagccgacgcccccgcaagccgacaagaagaccagggccgccgggacgttcccctcccccggcggcctgacgtctgaaacctcttgcccgcgcctgcccgggtccatgtagagcatccggcggtcgggccgcccgtggcgggcggcaggctgctgccccgcaggcattcgggcggcccgcccgctttgttcatgcgtatatgtcatgttttgattacacgcgctcgcctctgacgccgccaacttacgcgagcaatgtggtcgaatgtgggcaccaaccgcgacacgccgcgaattccgccattttccctccggccccatccccaaaagcaacatgtgcgcacaattctccggcccaagcgcacaaaacccgcaaagccccctgttcatccgcacgccaccgcacacttccgcaccgccgcgcacgctcccccgccccgcttgccaagcccgaaaagcctgcgataataggagttgcaaggcaaattgaacagagcggaagcccacaaaagtgtatggtcacaaggaccgatacgttgaacgggggcatgtgaagaatggcacttaccgttgcaacgatgaagttgtgaagagttccgctcagggatacgagccttgtgagaacggctccttcgggggccgtttctctttgtggtcccttgtgtttgcaagccgggagcccagggcatacagtacaatagtatggttcagaaattcgatgcgccctcccaggcgattctcaaacgtcaaatcgccgagcacatagcggagagcgataagcccagccgaagcccagccgagcccggcgacgacaagcccttgcccaaagaccgctacttcgaccgggagatctcctggctcaagttcaacaagcgggtgctggaaatggcccaggacgaatccctccccttgctggagcgagccaatttcgctgccatcttcgcctcgaacttggacgagttcttcatggtgcgcgtcgccggcctcaagcgccgcgtcgacaccggcatcgcggtgcccgcccccagtggcatgagcccccgccagcagctgcgagccatctccgagcaggcccacaagctccagaacgagcacgcgcactacgcgatcgacacgatcctgccggccctggccgccgaacgcatcgtgctgctcaagtgggaccacctgaccgcccccgagcaggagcgactctcccgcttcttccaccggcaggtcttcccggtcctgaccccgctggccgtggacccggcccatcccttcccctacatctccggcaactcactgaacctggccgtgctggtggagaacccgacctcgggcaagacccacttcgcccgggtcaaaatccccgacaacctcccccgcctggtggccgtggacgatctgacggacgaggaaggacgcgaggagcgctacggcttcatcacgatggagaacctgatcatcgcccacctggagtccctcttccccggcatgaggatcaaggaggcgcgttccttccgcgtgacccgtaacgaggacatcgacgtggaggaggacgacgctgagaacctgctcaacgccatggaaaaggagctgctccagcgccgtttcggtccgcccatccgcctggagatctccgacaccgcttcccccttcctctcccagctgctggccagcaagctgcgcgtgaccaatgaagaggtctaccgcctgcccacccccctggatatgaccgtcttgtacgagctccaatccatcgaccgcccggacttgaagctacgccccttcgtccccaccaccaaccgccaaatcgcccaagtggagtccagccaggcgcaagacgtgttcgcctcgatccgcgagggcgacatcctcctgcaccacccttacgactccttctccacctcggtccaggccttcctggcccaggccgccgccgacccgcaagtgctggccatcaagcagaccctctaccgcacctccggcaattcgccgatcatcgacgccctggtggacgcggcccacgccggcaagcaggtcctggccctggtcgagatcaaggcccggttcgacgaggaggccaacatcgcctgggcccgaaagctggagcgcgccggggtccacgtcgtctacggaatcgtgggcctcaagacccactgcaagctctcgctggtggtgcgccaggagacggacggcctgcgccgctactgccacgtgggcaccggcaactacaacccgaagaccgcccgctcctacacggacttgggcctgctgacctgcgacccggtggtgggtcaggacttgacccgcctgttcaaccagctctccggctacgcgcccaagtccagcttccaccggctcctagtggccccccgcaccgtgcgcaccgggctgatcgcccgcatccagcgcgaggagcgggccgcgcgcgaaggccacgaggcgtggatcaaaatcaaagtcaactccattgtggacgagcggacgatcgacgccctctaccgggccagccaggccggggtcaaggtggacatcgtggagcggggcatctgctccctgaaacccggggtgccaggcctgagcgagaacatccgcgtgcgctccatcctgggacgtttcctggagcactcccgcgtcttcgccttcgccaactcccagggtccgcaaatcggcgagggccccatatccggcccggaggtatggattggctcggccgacctgatgcaccggaacctggaccggcgagtcgaggccctggtgcgcatcaccgcccccgacgaggtggattcgctgatcaagtacctagacctgcaaatggccgacacgaccgcgtcctggcatatgcaggcggacggcacctacgtgcggcactcgcgcgacgaccaagggcggccgctggttgactgccaggagtacctgatagaccgtcattcgcgcggcggcaggaaccgctaggcgcaggctcaagcgcagcgactacagcggacgcgcaaggttgggaggaccgatgagcaagacagtcgaagcagccggtgccatcctctaccgttggcggcagggtgacccctcaagcgggcagggcgtgcaggccgacccccacgccctgctcaagcgcctggagctgtgcatggtccaccggcccaaatacgacgactggtcctggcccaagggcaagctcgaagcccatgagacccacgcccatgcggccgcccgcgaggtgagcgaagagaccggtcgagtggtccgcctgggcccctacttgggcgaatccgaatacccgctgtccaacgagggcaagagcaaggggtcgcacggactcggccgacgcaagcacatcgtctactggatggccagcctggctggtcatgcccgagccgaccgcctccaggccgtaatcggccacgtgagcatccccgacccggacgaggtcgaccaggtggcctggctgagccccaagcaggcgcgctcctggctcacccactcgtccgacaagcagatcctggacctcttcgtcgaccaagttgaacagggcgctctgactggcgcgaccctgatcattgtgcgtcacggcaagtccatctcccgcaaggagtggagcggggaggacgcccagcgccccctgaccccccgtggcgcggcagccgcctatgcgctgaatcgggagctggcctgctgggccccggacgacctgttctcctccccctggacccgctgcttgcagaccgtgcgcccctacgccgccgagaccggtcagccgatagaagaggtggattgcctgaccgagaccgccttcgccgcccagccagaccatgcttacgcttggctcgatgcgctgatagaggacgccttgaccgccaggtccactaaactggtgtgtatgcaccggccggtgctaggcggcgttttcgaccacctgcgcggcctgtgcgcctccaagagcatagcccggctcctcgccaagagttccccctacatgcccaccggcacggcgctggcgctccacttcgcgcgcggagcggacagcccacgaatcatcgacatacagaaggcgatacccattgtctactaacggctccagcttcggctcctcctccatcctgccctcccgcaccggcttcgtagccgcgcacggcgcctcccgcccctcccggcccggccagctggacccggcgatcgccgagcaggtctccggcggcgtggaccctcaggaagtcaatgagatgagccatgtctccgccgcctcattacttgataaagtccaccacacgaccgatccggaagtagtggagcgggtggtgacgctaatcgaccgcgagggcgtggacatcgtggccgagctctggtccgactccgccccggacaccctgcccggcaccctttggcggctctaccttctgcgttcctggatgcgccggcagggcgaccagatcagccgcctgtggcggatcggcgagcccagggacacggccgcctccgccatcgccggcgtggacgcggcccccgatgccgccgccatggctcgcaccgccgactctatcctctccggcgctttcaccggcgatttcgccctggccctggagcgcgccgccgccttctgcgaggtcatcgcccgcggccttcaagccggcattcccaccttcgaccaggccccacagtcggtccagcacctccaggccgctcagtcagccggcaaggccggtaaggcccagtccgccgaccgcaagaccgtctcctccctcatgaccacctcccgggacttcacccgagccgccggactctggcgtcagggccgcttagagtaacgtcgttacttaagtcgactaaacccaccccatccaccctcgccaaccgccccggctccacctcatccggcacctttaccgcgccccagcgcttgcggcgctgagcgtaacaccccacacaactggcggccgcgtagaataggtagtgcgtcgggccgtgcttaagccccgggctccatttattgccgccgcgagcggcgtttgcgccgacaggcgctttcgcggtccgacgtttcacccctttttccaacgttcgcggtccctcctggacaccggtttgacggatatgttgcaagcgttatcattaaaagctattgacaggctcgcatccccatgaacccggaggcattggattcacagcgcttgcaatcgactagggagccgaaggccagcagacgtccacagtcggacgccgaagcccgtcatgtacccaagatattggtgtttacaaggaggttgacccccgtgtcaaaatacacgttcgatttggcgttcgataagcacgtccccaaggtggacctgccgctgtcggaccagcgcaagcgctggttcaccgagttcatgaagcccttcctcatggtgaccttgctgtacagcaccatgtacttcgtgcgcgacgacttcaaagccgcccagcccctgctcaaacagcagatgggcctgaccacccagcagctcggcctcatcggtttcgccttctcggtggcgtacggcatcggcaagatcatcgtcggctacatcgtcacgaacaaggacaacaaaaaagtcgcctccatcatgctgctggccgcctcgatcctggtgctgtgcgtgggcttcctactcaccatgaacagcgtgccgttcggctggttcctgtccctgtgggcggtcaacggcgtcatccagtgcgccgctggccccgcctgtgccggcaccatcctcaactggaccacctccaagaactacggccgctactacggcgcctggtccgcctcccacaacatcggcggcggcctggctggcatcttctccctctggtgcgcccagaccttcttcggcggtcacgtctacggcatgttcatagccccggcgatcgtggcattcgtggtggccttcatctgcttcttcgtaggcaagaaccggcccgaggacctgggttggggcaccgccgagcagatcttcggcgaaccgccgaaggtcgaggacgaggaatccaccaacgactccacctgggagctcttccgcaagtacctgctcaccaacccgctcgtgtgggtcctgtgcttctcggatgtgttcgcctacgtgctgcgcgtgggcatcgacaactggtcctccttgcgcgtcaccgagcagctgggcttctccaaccaggtcggcgcccaggcaatcttctacttcggcatgggctcgctggtcggctgcctgatctggggcgccatctccgacgccttcggtggccgccccggcctggtctccctgatcgacctgggccttgccgccatccctctggccgtctaccaggccgccaagaccccattcacggtcatggtctccctcttcttcctcggcatgttcgcgttcggcccccaggtgctgatcgccatctcccagttcgcggtcgtccccaagaaggcggctgccctggctggcggcatcctgggcgcgttcgcctacctgctcggtgattccaccggaaagctggtcctggcccgcatcgccgattccaccgcctccggcatcaccctgttcggacacaacttccacggctggaacgacaccttcgccctcctctacctggccgtcgcctgttccttcgtgttgcagatcttcgtggccatccacgaggagaagaagattcgcgcccgcaaaaaactcgccgccaccgataagtaagggtcacccaatatgactacagcatcccagccggtcaccatctacctggcccggcacacacagaccacgtccaacatcatggacatcatgcagggctggtccgatttcccggtcacccaggaggggcggggcatcatccgccgcctgggccggggcatgcgcggcatcgagttctccgccgcctactgcggcaccctgccccgccattacgagaccgcccgcggcgtgctcgacggctcgggcaacgagggtgtgtccatccagatggacccggacctacgtgaggacaatttcggctccttcgagggtcacagcacctcgggctccatgcaggcggcgatcgagcacatggggtacaagaccatggaggagggcgaggcggaccgcggcagcaaggtccatctcgacatccaggacgccctgtatgagatggaccaggcggacgtgctcaagaccacgctggccgcccaggaccgcgccgagacctccgcccaggtgcaggagcgcatgaacgcggccatgacccgcatcgcgcgcaagggcgagcaggagggctggggcaacgtcctggtcatcagctccggcctgagcatccgccagttcctctacgtggtggaccacggcacggacttctccgaccccaccaacgccacggtcaccaagctgacctaccaggatggcgccttcaccatccacggccgcgtgtgctcctcggagtactacgaccgcggtggcgaggagtaacccaagccgatcccagaccccggcggtccgctaccaggcggactggccggggttttggcttattaccagcgtcttcacctggatctcccacaagccgggccggggctgtgtcccaagcgcatgccgtgcgctaggctgggaggtatggaactccacgtattacagcacccgctgattgagcacaaactcaccgttttgcgggacaagaacacaccttccaacaccttccgcgagctgaccagcgagttggtcatgcttgaggcctatgaagccacgcgcaacctggaaatcgaggacgcggcgattgaaacccccgtggctccgatggtcggcaagaagcttgccgccccccggcctatggtcgtgccggtcctgcgcgccggactggggatgctcgatggcatgacccgcctcctgccaacggcggaggtcggcttcctgggcatgaagcgagacgaatccacgctcgacatcatcacctacgccaaccgcctgcccgaggacctctccggccgccagtgcttcctgctcgacccgatgctggccaccggcggcaccttgatcgccgcgaccaactacctggccgagcgcggcgccaaggacgtcacctcaatcaacatcctggccgcccctgagggccttgagcacctgaaagccgagatggacccgaagatcaacctgaaggtcgtggtgtgcgcggtggacgaaaagctcaacgagcacgcctacatcgtgcccggcctaggcgacgccggcgaccgcctctacggcgtcatcaactgaactcagtaagaccaacccgcccccgcgcggggcttgagcgggcccggactcccagcggagaccaggcccgtttgtcgtttccccgcctatgccttggaaccgtgccaccccaggccttgattgcggcccgaaaacgccctgagcgcacaggaccgcgcctcaaccgaccgagacaacctgaggccggggcttgcgcttgggcacaaggtggctgaagcggaccaccgagagtagaatcgcgcagaaaatcagcgcgaagcccaccatagacgtggaagtgattcgctcgcccatgaagagggccgagaaggccaccgagaagagcgattcagtgcacaggataatcgaagccgatgaagcggagacatgcgccaggcccacgttctgcatcacctgcgcagcgaatgtcgcgccgaagagcaggtagacgaagctcagcaccaccggcgtctggaaccaggaagccgaggggagcggctcggtgaacagggcgccgaccaggaagcaaaccccagccacagcgaactgcatgaaggtcatcgacaagggtgagaacacgcgggtgaagtggcccatcagcgccaggttaaccgcgtagaaggccgcgcagcccagggtcatcaaatcgccggaggacagcgaaagggaggccgaacctggtttcagcgccacgaagcccacgccgaccaggcaaatcaccgccgcgaccaggttcaccagccggggccgacgacggaacatggcccaaatggcgaatggcgtcagcacgcagtaagaggctgtcaggaatgcggagcggccgggctcgatcatgcgcaaaccctcggtctgcaaaagcatgttcacgtaataggtaccgccaaccgcgagcgcaggcaggataatcgcgcgcgtcaggcggggggtgatccgcttgtggaagaggagcatcatcagcagacaggcgccagtcatcctcagccccatcagccactggggcgatatggcgcgaatggcgactttggccatcaggtaggagccgccccacaaggccgcgcagcacatgagcagcacccgcgccaagttaggcgggaaagacaggagcacgtaccggtacagcttgcgaaaaccagctttcagcaggcggtagcgtccgcccatcccggtcccatccccttggagcgcgcgcataccgctcttgacaatccgtacgcctgattgaaaactcatctacgcccaacctgttcgctgcaatcggttgactcgtggcacccctcgcggagtagcttcactataggcaaaaccaagtaacaacatgccgcctcccttggtaaagattacgtacagtttcaccgtggccaaagatcgataaaatagctggcctcgaacagggagaaaggggaggctaaggcaggttgaagccgctgcaatctggggcgtttaacgcggaccggcaaggggcagcgggcgcgcaggaacgtaggactcgaagatgaaacgatcgaaattggcgcgggattggctctgagcttccgcggagcgtagcgtccatgctactgactcgccccctagggcgcggaagaggcgcaggggcggggcagcgccgccgtgccactcgtaggcggcgaaatcaggacggcccagccagtccagcaacaggtttccagccagcgcacgggccaaatcagcggatgaccgcactttgccgtggtaggggacggccaactgcccacggcagacggtgggacggtggcggcggtaccatgccagcgccaacgggttgaaggattcaatcaggtacggacccgggtaagcggacaggagggcatccgtccgctccatcagctcccagtccagcgcgctgcccatcttgtactccaccaaaatcggcacacggccatccacgagggccagcacgtcggacagcaagggcacatgaatgggttcagaccgtcccgcatgcctggcgtggtagcggtgccccgtcgcgcgcatgggggacgacccgacggaagcgttggaagcaacgggagcaggccccaacgtcacctcccgaagctgcgcatatgtcagatcagcgaccttccgctggtcgccggccaccctgcgcaaatcgtcgtcgtggaccaccaccacctgcttgtccttggtcaggcgcacatccagctctatcccgtagccggcctggcaggcagccgcgaaggcgggcagcgagttctccggcgctaggggcgcttgcgccgccgggccaccgccggcttcagggtcaacgcccaggccagctgctgtcccatcagcgctccgggcatgagccgcgtcagggttcaatccaaccagggccaattcctgagtgaccgcctcggactgcgaggtcctccgcgcccccgccccgcgcggactgcggtcagcgagccccctgggcaccgccttatgcccgctgacgcgcctcgccccatccccaccaacaatcctgcgggccagagccacgtactcacgctcaccagcgtcgtccttggacgggtcagcctccaacccggacccagcatcgtgcagcccccggtgggcgtagcaagcttgaggcagcccaagggccccttgcagccggcgcgcggcctcgggccggggggccaaagcccacaccccgaccgcgcccacagccaagccgacccctgctaatgctttccccgccgagacgatccgtgcaacactccccattgcgcacctccgttcccatcctagcgaacggcgacggcagcccagccggcaacctggcaggccgcttggcccggtccggaattcagctggatttgtggcgggtctggcggcgcttggaggcgcggttcttaatcaaaatgtcgaatacgatccagacggagaggatgaaggccaccacgtagcccaggagccccaccagcgggatgccgaagacgaacggtttgattcgagcgaaatagacgatggacgaacccacgtacagccccaccacaatcagcgccatagccaggcggttgaccatatcggacagctgccgcaggggctcttcagagccgacgatctgcatattgagccgcatctggcctcgcgtgagcatccgggaggcggtgcgcgactcagacagcgcccccagcagcccatgcagggccgcgttcgactccaaccccaactgcttaccgccctgtttcagacggtcctccacgctcaccgaggaggtgaggtgctgggcgatgatctccaccatgttcgcattgggcaggaactcatccaagagaccttcgagcgtgaccaggcaacgcgccacgatcgtcaccgaactggggaccttgatgttgtgccgctgagccaactgcatgagcgagttgatgtattcggctatgtccaggtcggccagatccaccttgccgaactcctccacgatcgcgtccaggtcgctcagcagggtggagtagtcgtcgggcctggtctcggcggtgccggtaaagcgcaggagtccttcggccagcgcgggcgaatcctccttgcccaccgcgaaaatcatgtctttcaggaccgaacgggtcttgacgtccaggcggccgaccatgcccaggtcgatcagcacgatcttgccctcgcggatgatgatgttgcccgggtgcgggtcggcgtggaagaagccagcgtccaggatttgcgtggcgtagttgtcgaccagcttggtgccgatttcgcccaagtcgtacccggcggccaccagctgggctgggtgggccacggagatgccgtccacatactccatcaccaccacgtgctcggtgcagtagcgcgggtagggcttagggcagtcgatataggcgtatggcttgcagaattcgcggaactggaccagattgcgcgcttcgtcgacgaagttcgtttcggtttggaaggtctgccacagctcctcgaccatgcccttgatgtccaccacctgggaccgcctgggagccagccgccccgcccacttcacgaaggagcgcatgatgtcgatgtcttgcaccatcgtctcgcgcacgccgggccgctgcaccttgaccgccacatcctcgccggtcaccagccgcgcccgatgcacctgggccagggaggccgaacccagcggcgtggcgtcgatcgaggcgaaaatgcggtcgagcggctcgtcgtattcctgcgccagcgtatccatcacggtggcgtaggggatggggtcggcatcggcgcgcaacttggagagctcccggcagaaagcctcgggcaggatttcggagcgcatggagaggatttgccccattttgacgaatgtgggccccagcgcctcgaacatgagcctcatggtcaccggcgtcagcccgtgaatcacgtcgaagcgggcggcgatgcgcccaatctgccgcaagcgcttgagccgggaacggtggttgggcttgatgccgtccaccccttcttcccccctgccagcgttcagaccgaagagcccgattgtgggcaccgactggcctcggtccagcccctggccggaccttttagggccggggaagcctgcgtcctcgccgctttgagacatggcttgaccccttcctacgcgtagccgccgcctacgttcactacctactacctgccactggttcgcggcctgggctcgcctggcgggttccgtctggctcccggccgtttcaagcagcgctcattcgcgcggcccgcccttcctggccgcgcgaaccgccgcgccccagccgacgctcttgtcagtactcggttatcagcacccggtcttgatgttgtagaccgcgccgggcgtcggcgtgggcatcgaacccccggactgagtctccgcctgggccttggcgtcagccgcggcccgctcgtccttggcttcctggcggttggccgctgccttgcgcttgagctcggtgttgagttccttgccctggttcacggtcagctcgcctttttcgaccagctggtccacgatttcctggctcttttccacgccggtcgccagcgcgccgatgcccgccagcatcaccttgcgcagcccatcccctaaattcaattcgctcatcacagacctcctcgattaccgccgcgcgccttagacccgcagcccgttcctccagtctagccgctcccaaccccctcacccgtttcagccctccccatcctcaccaccagcccatacccttgatttcgtgaaaatttgccggattcaaacccctgatttcgtgaacgtatgggctgcatggagtggaatccagcgggaaacggattccacccgcccgtcggtgaaaatgaatagggactcgacaaaagcggacaaagacccgggccaggtccaaggcacgagggtatgtaacaggtccgccgcaaggggacattaccgttttgaaccacggcccgccggtcgaggacgagcagattcaaccgtcgcggcacctgcggatggtcggcccaatcgccagatccaacaacggctttcccgccacccgcgcgttggcggcggcgcgctcgacccccccggacgaccctgtacgattaccggtttgacgcagaccgaacgggtgaggccttaggccccgaggtcggcagaccagccgcatgggcgggctctcccccgctttacgcaagccctggacgcgcccctactctcctgcctgccctgaaccgaccaccagtcgaacgcaggcaaatggccgcttgaagcacgcgggcaatgcgcgcgtaagagcctcatgaatgacagattcacatggttctatcggtaatgaacggacatgttcgctggcatggagacgcggcgttcaagggctctcgcgccgccgcgcgccggcgagcacaagcaaatcttccaacagccgcccggagccagctcatcgacccgcgcgctcagcgcggacgggcggaggccgcctggcgagcctgggcggcggcctcgtccaggcgggcgagctcggcggaaccgggggcggcggcagggtcgaaggaaccttgaccgtaacgggcctccacggcggtgcggataaggaaatcggagatggcggggtttttgggcaggagggagccgtgcaggtaggtgccgatgacgttgtgcacgcgagcgccctcggtgcggtcctcgccgttgttgccgcaaccatccgcgtccacccgccccaggggctcgacgcctgggtcgaggaaggtctgcccggagtggttttcgtagccgatcgcgtcgccgaatgagtccgtatgctccaccaggttgccgatcatgcgcaccgggcggcccaggctgtaggcgccgatgatgccgatgccgtccagccgctcgccgtcgatggtctcgaaataatgcccgaagagctggtagagcccgcagaccatcagcatgggcacgcccgcttccgccgccgccctcagtgtgtcagcccgctcgaacaggtcgtcgataatccgcccctgaccgtggtcctggccgcctccgcccaggatcatgtccacctggtcgggccaggcgtcgccctggttgatacggtggatgcgcggctggtagccgtagagcgccaatcgccggctgaccgtgagcacattgcctgagtcgccgtaaatgttcatatcctgcgggtacaaggagaccaggtcgatggcgcgctcaggcgcttcctgaccagcctgcgccgcttcggacctgtcagcagcctcgttcaccatctcgacgcccttcctattcgcagccgccccgctggcttcccgcccgctggtccggtcttcctccgtagtcgtttccgtcattcgtcaccctcaccaaccgccggccgccggctcgtgttcccggcggttccaacctgagcttgccgccttatgcccccacgccagcgtccgccacctgcgtcatcctgcccagctcggcccgcaggcgcagcatggccgtgtaggtgcagtagacgcgcttgggggtgcccgcgtgggcgcccgcgaaccgatgcagggcctcctccaagtcaggctcgaccgcgcccacccgcacctggtcataatccaggcgcagggccatgtcccaggcgcgcgtgccggacaccatggccacgccgccggggcgcagggaggcgaagtccacatcccacagccagctcatgtccctcccgtccgcgtattcgtcgcggatggcgatcatcgtgtcgcttccagcgggattgaaggaggacaaggccaagcggaatcccattgggttcttgaccagcaccagctcgatcggagcgccctggtactcaatcacctcgccccgcccaaaagccggggtcacctgcgccaaagcccgcatgagccgctggtccgaaggcatgggttggccacccgtcgcctgccggtcggacagcaccgcccgcaccagggccagcgcggccgccgcattgtagagattgtagacgccctccagtttgacctgggtggacagcgcctgaccgtccacctggaaggacgccgtatggtcacccaccgccgtgagcacgacatcggccgccagagcgtgctcgggccgggcggccagacgcgccgccagagcttgcgtcgaatccgtacccgccccggagcccgccagatccgcatcgtgcatttcgtcgtccgaggggaagtaggaaaggagggaatcagccaagccaaagtagcgcactgaggcggtggcggcggtcaaaccagcaagcccagccactcgtggatcctcccggttgagcaccacggtgccgctcgtggccttggcgacggagccgagcaggcgggcggtgttgtctatctcgccgaagcggtccagctggtcgcgcatcacgttgagcagcagcgcgtaacgcggtcgaacctgttgcacgaaatgcaccgcgtaggcctcgtcaagctcgagcaccgctatatcggcgtccagccccccaccgcccgcgccggatcccagctcggtgaccagggccgaaaccacgccccgggtgaaattggagccggtaggattcgtaaagaccttgagccccagctcctccagcatggaggccaccatacgggtggtggtcgtcttgccgttggtgcctgagaccagcaccacgcccatcggcagctgggccagggtgcgggccaagaacgtggggtccaggcgttccaccaccttacccggcagggccgagccgccgtggtgggtcagccgggacagggcgcgcgccgccttgcccgctggtaaggccaggaagccataccagggccgccgccggggctttggggccgccgcctgcttggggtgcccgcctcgcgtcgtttcgccggatgccatgctcacacgcctccctgctggtcttgcggcatgtccttgaacttggatttctcgccaatgaaagccagggtgaaggtgtccgtggggccgttgcggtgcttggccaggatgatgtccgcctcgccgggccggtcttccttgtcatagaagtccgggcggttgaccagaaagaccacgtcggcgtcctgctcgatcgagccggactctcgcaggtcggagagcatggggcgcttatcgttacgcgcctcgggcccacggttcagctggctcaacgccacgaccggcacctccaactccttggccaggagcttcagggcgcgggagaactcggagacctcctgctggcgagattcgacctgccggcccgaggtcatgagctgcaggtagtcgatgaccaccaggcgtagttcgttggtctgcttgagccgacggcacttggcgcggatctccatcaggctcaagttgggcgaatcatcgatgaagagcggggcgtcctggagctgaccccagaagttgttcagcaccttccaccgctccggggtgatgtcgtcggcccggcgcagcgccaccagcggtatgtcggtctcggcggagatgatgcgctgggccagctcggtcttgctcatctccagggagaagatcacggtggtcatcttgttgtggagcgcggcggcgcgggcgaaatccacgcccagggtggactttcccatagccgggcggcccgccaccacgaccatctgccccggctgcaggccctgggtcacgtcgtcaatggacttgaaccctgtaggcacgcccttctgcaggtccccggactgcatcttgtccaactgctccagggtggattggaccaccggcccaatcgcctcataatcttggcggaccttgcccacactcatctcgtagacctcggcctgggccagattcacgatctcctcggcctgggagccctcggcggagtagcccatctgggcgatcttggtgccagcggcgatcacattgcgcaggacggcccgctggtggacgatgtccgcgtaataggtggcgttggcggccgtgggcaccgaggccaccagggagtgcaggtagtccgtgccgcccactttctccaggtcgccgtgtttgagcagctggttggcgaccaggaccgcgtccaccggctgggaggccgcgaagagggtgatgatggcgtcgtagatggtctggtgcttgggctgatagaagtcggtcacgtcgatcatctgcgagacctcgccgatcgcgtccttgctcatcaacatgccgcccagcacggccatctccgcatcgtcgtcatgcgggggcacgcggtcgaagagcatgtcccgcgagccctggccgccgcgaccgtcctcccgctctgggtgcgagaagtccctgtaatcatctgaagccatacgcccgattctaaaggctggtcggtatctgcagcccagcctccgaccgtttccgcccaaggcgtttacagggccgcttccgggtcgcgcgggcactttcttcacatcttcacgtttgacggtcacccattcacgatggaacgaggtcgcccccgtatgtggacgaggaaaaaagttatccacaatataggcgtgtctgcggggagaaccgactgacttatccacacggtgggtacaactatgtgcaaaacctggggacagacataggcgcaacttggacgggttgcgtcagcgggcgctctatggtatcgagcgtcctcccttcacaagtgtgcacaaagacgacgccagactccgcttttcgacgaccatcaccagcggcgatgcctcccctatatagaatcaactgagcggcgcgcggcgccgagggcacgacaggggcgcggctgcgcccggacagaggagagcgggatgcaggagcaggcgggcgagggacagaatcaggcagcgagcgcgggcacagccggaccgggcgccgtcaccgaggccggtaccgggaccggagcggacaagcgctcggtctaccggcaaatcgccgccctggccgtgcccaccttcggccagctaatcgccgaaccagcattcgtgatgatcgacaccgcgattgtcggccacatatccgacgccgccctggccggcttgtcaatcggctccaccgtcgtgctgaccactgtgggcctgtgcgtcttcctggcctacggcacgacctcccaggtggcccggctcatgggcgctggcaagcgcaaggagggcatggaggtcggcgtcgatggcatgtggctggctttcgcgatcggcatcctggtctgcgcggccctggtagccgcgagcgaacctttgtgctggctgatgggggcgcgcgggcccgtgctagccgcggcccgggtctatctgaacgcgacgatcttcggcctgcccgccatgctcctggtctacgcggcgaacggcatcttccgcggtctgcaaaaggtcagaatcacgctattcgcggcggtctccggcgccgtgctcaacaccgtcctggaagtcctgctcgtcttcggcctgcgctggggaatcgccggatcgggcgccgccacgctcatcgccgaatggtacatgggactgttcttaaccataccggcgctggtctgggccaagcgggagggcgcctcctggaagccccgcctggccggcatcctcagctcggcgggcgacggcctgccgctcttcctgcgcacactggccctgcgcgtgtgcttggccggcacggtagtggcggcggcgcacctgggcgaacaggtgctggcagcataccagggagtgaattcggcttggaatttcggactgaacatgctggacgcggtgggcatcgccgggcagtcgctggtggccactgagctgggcgcccgccacaagccccgggcccgcatgatgaccggcctgtccgccaaggccggcatggtgatgggcgtgctggtcggcctggtcatgatcgcgctaggtctgttcgccgctccactgttcagccccacgcccgccgtgcgctccctgattaccgtgggcatggcggtggagggggtcttcatgccgatcgccggctggatgtgggccctggatggcatcctgatcggtgcgggcgactaccgctacctggcggccacctgctcgtccaccgccctcatctatgtggcggcgctgaccccgctgaccctgtgggcccaaacctgggccagccagacctggcgaatcgtcatgctctggtccgccatcaacttcctcttcatcggcgcccgcgccatcttcaacggcttgcgcgcccggggcgacgcctggatggaccgagccttggcttccgtctgaccctgcctggcctggggtttgtggaccgctccgggcgtcaaaaaagccctgcgccccttctcgctgttgcgcaagggacgcagggctgggcggcaacgcttattcgccgcccaaaatcccatccacgaaggattcggggtcgaaggatgacaggtcatccggcccctcgcccagtcccaccagcttgaccggcacgccaagctcccgctggacggacacgacgatgccgccccttgccgagccatcgagcttggtgagcacaatgccggtgacgccgatagcttccgcgaagaccttggcctgcaccatgccgttctgcccggtcgtcgcgtccaggaccaggagcacctcgtccaccgacaggttcttctccaccacccgccggatcttgcccagctcatccatcaggttggccttgttctgcaagcgcccggcggtgtcgacaatcagcaggtcggcgccggactccttagcttgctgagcggcctcgaaagccacagaagccgggtccgcaccctcccgctcggcgcgcacgacctgtacgcccaccttcgacgcccaggtctgtagctgggcggcggccgccgcacggaaggtgtccgccgctcccatgaccacggacttgccctcggccacgaacaggcgggccagtttgccagcggtcgtggtcttaccggtgccgttgacccctaccatgatgatgaccgacggtttggccgcacccggccgggaagccgccagggagcggtcttggccggtgtcgaccagggccaagagcttctcccgcaacatggcgcggaccgcttgagggtctttttcaccccgcacgcgcgcgtcagccctgagctcgtccaccagctgctcggaagcctcggcgcccacgtccgcccgcagaagggtgtcctcgacatcctcccagtcggactcgctcaggtggtccttggtcaggatcgagaagagggccttgccgaaggggttcggggacttggctagcttcgccttgagccgggtcatgctagatgacgaggactccggcttctccgcggccttggatgccaccgacccggcttgcacgggctccgcctgccgttcatcggacccggaagagccaagctgcgcggcttgccctccttcttccgcctccctctgggccggttgggactttgcctgcgcctgggattgcccggaaggacgcgaatcgttgccgcgcctgcgcataccgatgaagatgcccgctgctatcaggacgacaacgacgcagatcagggcgatgatggcgtaagtgttcataccttcaagagtaaagtcgctaacggacacccccgcgcagcgctctacggccgcaagggccagaagacgagcgggtcactccccctggcgggacagcgtatccaacgtcgcggccttgggttcagtcgcctgaccgccaaccgtttccttgccgggcgcttcggatgaccgagccacttcatcctcgtcgctcccgtcctgtccgccctgtccgtcagctgcttgcgcgcccgagcccggaatcaggagggaacgcatctgaacgacggaggagtcgttgacatagaccgggtgctccatcgtgtcctcatcgtcgatgtagggttgggctcgccggagcggctgccggggctcttgaggggtgaaggacggggccgtcccggcgattcgcggcaggagcttcggggtggcctccttcgattgcccagcgcgatcccgccgggcagcccgccgtcgggtccgttcattcaccgcctcggagaaggcgcggtcgtgggactcacccctggccaagcgcaggacgaagaccaccagcgccacaaccacggctatccacacaagcagaatgacccagaccatatatctattgtcgcagggagcgcccattcgcgtaagccccacccgcaaacatcccaagctcattcacaagcgcgggcaggcagggcccctcagtgcccaagctgcacatagtagcgctcatacgccgccccatccgagtccacccgggtgtcctccaagacccctccgcaggacaggatggtcctccggctggcttcgttcgaaccgtcgcaggtgagcaagacccggctcatcccctgctggcgggcctggctcaagcaccgccgcaacaggagtccggcataaccgcgccgacggaaatcaggatgcaccgagtagcctatgtgcccaccacggtcgagcagggcatcgttcagcgccaaccgcagttgggccatgcccaccacttggtcgcctggaccgagcgcgcagaactcaacggagggcacccaaccttcaggcaggccctcgcccgcagcctcggcgagcgcctgacccgcccaaccccgttcggcctcatcggcgttggcgaagccctccaggcagcccaggcccgcagtgtggccaccatccgccgccttacaggcgcgcatgtgctcccaagccgagcgcgcataacgccgtgagtcagccccgacctgctcgatcctgacctcgcccatcgcgcccccaccgatttcgcccatgccaatccccttcacgaaagtgcttgcattttagcaaccccggccacctccggcaaccgccatccccaaaacgcgacttgccttgtgtcaggctggttgtagaatgatatgaagttgcccctctggctcaatggttagagcagcgtccttttaagtcgtgggttctgggttcgaatcccagggggggcacaggctgaacaaggcacctcggtccggaaccaatcgaggtgccttcagtattcttgtgcgccatctgcttcatcagaacgccatcggcaactgctccgccccggacatcagggccatccctctgtcgaggtattcatagattttatcctcataatgtcacacacatatcttaaccagatgagaacgatacaaactgttctcgtattctttactattcttttagttgtgttttcgttgtatttttctacgatgtgtatgtgcgcattgcccatttgagggaagggcgggaacccagcacactgtggtacgtataacaaaaggacaggatttgtagtcaatatctagtttcatccatcccggccgctcattgacggcaaccgccctactggtcggtttatgtccgaccggtggtagtgccgcctccgccgctacgggcgaatctccgccatccatttcgactattcagacgcaaacggcaggccagcaatgggccatcgatctcgaccacgggccagatgccggcggcgctaccgttaccctcaccccacctgaaaccggtcgaatcacacagatcagcgctggcagaaactacccccgtggcgatcgattcgaacggcaacctctacacctggggaaacaactactacgacgagctgggacgcgacaccgacagcgtctccccgaatgggaggtcggggcgggtggccttccccgatcaggtcaggctcgccggcgtgaggttcgacggaattgcgggcgtggacctgaccgccaagacggacggcacctggagcgtgtccacccccgcgcatgcggccggcgcggtcaccgtcaccgtcaccgtcacctggaccctgaacgggatggcccagcctgacgagcacctgacttacacgtatgaggccccggtggccacccgtaccgtcaccttcgacccggacagcggttcggccctctcggcccaacgggtcacggacgagcagaaggccgtcagacctgccgacccgaccggggacagtcaccggtttaacggctggttcaacggaacgggcccctacggcttcgaccagcccgtcaccggcgacctgacctcaccgcccactggacccgcaatgccgacgagaaaccaaccacccccacacagaaaccgaccaaccccacacaaaagccaatcgaccatacacagcagccgaccggcccgaccggtaacccgaatccgtccggtgtcctgtccagcacgggcagcgacaccgcccccatcctggccgcgggaatcctgactctggcgagcattcgcacaggacgaaggatcgcacacggctcctccgccaagtagaagaacggtaaccggccctcctccatacagacagacatcggttatacgcccagccccataaaacccgacaccgctcagcggtcccgggtcccctccccgacggagagccgacgcagaatcatcaatgtcacagaagcgggcagagacacaacatcccgcatccagcaggacataattgccaccgtttccttgtgaatcatgggttatgggctcgagccccacgagaggccaccagaccgtgtaggaaaccttgagcttgataccgacatgaacgctacgcttgattgccgtctccgacgtagaggttcacgcatcgatatagagcctatcggaggtgcgtaccgatgacatcaggcggtaccctgcccttcgcaggggccgccgcgacggcttcgcactgtggccccaccagcacagatcgatacatttccagattccccgcgcatatcagcttcggtaccatcgtgggctactcaagaatcgcaagaatcctgtcccgactcctcaagaccaatgccgaccatcgtctcttccctatggcaactgaccttggcaagccgaagtcacgtttaggtgtggtcttcgccaatggcggtgacaggcgattggaacccccgatcagccgtcatggtgcgcattcccatgaagagcctgaaaaagctgtggtcgaacgtatggatggtcgcgcctctcaccgttctgatagctgcaatctgtaccagtacgcgtttggagcatacccgtaactctccgattgaccgacacgtgcacctcatcgaaattctggaggcgtatcctagcccgctaatcccacaggataaaccaggacatgtctccaatacggaatcggcgaggcttttcaggagatgggcttgggtgcggaatcggtgtcaagctcgtctccattattgttgatggcagctgtttcgcccttacctgtccccccgtgttggtcggcgtcctttacggcgaattcagtatgggtatgctccgcagacgcagctgcatcggcggtgaatccacacctcgcccatcgacgttctccttgaacaggccagatatgtcgaccagggttgtgcagcccggattattcgaccgcgagtaggcggcgcttaccgtacccttcagtttgctgttgtccccccgggtatccttgataagcacctgtcggtgttccgtatgcggtccggtcattatggacaggctcttcataccctattgagtccccgatgccccccccccgagaaaaccggcaccgaaaaaattcacagccagaatgccctcccttcggacaaaccgtcctcgaaacctgcgaggctgatacatcgcccacagggtcagctaccttcaccaatctacgatcaggaaggcaccggggttccggcattagcgattgacgcaatcgatttgtcgcaggtctgcaagcgcatcagatgcctttggcctgtattgtcaaacacccgtgagtgcagttcctcacgccacatgccaggcaccatcgcttatggtggggtggcttgatgctcctcgttccacatgtttggtacctcactgaagcggtgcagcggaaatcggcattcacgcatatccgtggttggatccaattgcccacaagaggggcaggaaccggaatactagagctggcggtttttgctacggtaatcatcgggggtcgcacccagatatttgttgaacagccgaaagagcgatgtcacattgcggtagccgatcgcctcgctgatttcctggttcgaacagtcggtgccgttcatcattttctgcgcctcgatcagtctgcggcgatccaacagctcctggaaaccttcccccgtggcctttttcagtttgttgctcaggtagttggggttgtaaccgaaccggtcggcgacggataccagactcaccgtggcatagtgccggttgatatatgagataatcggagccacctgctcggcctggatgttgccgaaatcgatgacactcttggaaatcaatgctttcaattcaatgaccagtgcggaaagcaccagctccatggcccggttccggccaacggtcggccggccagccaacccttgctcgatgagcacctcaatcaggttggtgggcacggcgtgcccttgcaggtcgaagacgatgaggttgtcatgcagggtcgaggcgttgcccacgttggcgatgagctgggagatgacattgagggactctggagccatggtgaacatggaggcgatgtccgcattctcctgaacgaggatgttcaccaggatatcgtcttcatcggtataggagattctatggggcactgccttgtcgagcatgaccagactgccctgatgcagctcgaccagctcgttgttgatgtattgcgtgcaccgcccggaatacatgtagttcatctcgatgaagctgtgggtatgctcgggcacgtatgaaaaacggttgttcttggttacggcgatgctgccatccttgaaaaagatccactccggcatctgcggcacggcatcgttggagaaatccaggttcatgtaattaaaattgctgaccgtgctgagctgctggcgttcaacatcattgtgctcatgcaggatgcaatcaagtcgctgtgaaaacatgacaccctcccggaatcaggcatacggggacagccggttgaatcaatatcctgtcattcgtctaagccgaccataccacgatggcaagaacctgtggatttgcaattaaagagcgattggctgcctcttgtagccctgattctccgccgttacgatgaatctacgtttgaaaattcagtttctcaatcaacgaggaaagggaacatggaacagatatcggaattcagcaagtaccggcctctggccattgctgcgggaatcggctcgattctcggatcaggaatcatcgtgggcctctcggccaccatcaccgtctggcagcaagggctgggtcttaccaatggccaggtgggcatcatttccggtgccttaacattcgccattgcagccggatcattgctctcaggccagatcaccaagtatgtgggcctcatccgctcattcaactggctcaacttcctctatgccatcggtgcactggtctgcgtattctccggaagttacgccatgctgctggtgggtgtcatcatcaccggcttcgcatcgggcgccgatctgccgatcagcctgaccgtcgtctctcacgattcccccaacgagaagacctctgcccagctcgtttcatccacccagatcttctggcaggtcggcgtgctcagctcctacgtggccgccttcctggtctccagagtcagcggcgccaccggggcccggatcgtcttcaccctcctggccatcgttgccgtggccacctggctctggcgccttttgtccgccaggttccgcaccttccatgaagaggccgaccaacgcatcgcccaggtgcgcgaggccgaggcagccagcggtcacactgtggtcagcgaaggcagcgaggtcagcatccgcagcgtcttcttcagtaaaggcagctccaagtatgtcctcttcttcacctgcatcatggtcttctacctggcatggaaccttctggccaacaccttcggccagttccagaccttcaccctggtccaggcccacgccagccagactttcgccaccggtgccggcatcgttctcaacctgctcggtctggtgaccacctccatcttcgcctccatctccggcggcaagtggcgcaacaccgtcttcgtcatcgcccagatcatccagatcgccgccatgctgggcctggccctgagcagctcctccctctggcccatcgtcatcgccatcggcttctacaacatcggcaataacctcgccggcgaggccatgtacaaggtctggacccaggagtccttcccggtggaggtccgcgcctcggtccagggcttcatcaacggtttctcccgtttctgctgtggtctcttcgccctgatcaccccggccctggtcgtcccctcggccatccgcgtaaccatgttcgggtttgcggccctcctgaccgtcggcctgatcggcggtctgatcatgattgccatgcagaagaagtacggcgtccgcgaggcggaagtctgacgggacgatgccatgcaggggtgtgaaggcggccgcttcgaccacctccctacgcccctgcatttttgaaaggtaagacaatgggattcacgttccagatcaacaacgacgtcacattcaatcacgacgagcgtctgctcgccaaggccgaggcactgcgccccaagctccgtaccggcaccatggaaccggtaggcgaaggcaccttgaccgccaactccgaatcattgggcggggtgaccgtgacaacggacacctccacagccagacaatccaagcccatgaagcgaaggaattcgctgatcctggacttcggcgaccatatggtcggacacttctccatccacatcgagtcggtcggctcccccatggacgcacctttgaccctgcgcctcaaattcgccgagctccccgttgagctctcccaggaaagctcaacctacgacggctggctgagcaagtcctggatccaggaggaaaccatccacctggacacccttcccgtcgacctcgaaatgcccagacgatacagcttccgttatgcggagatcaaggtggtcgacacctcccccaagtggcaagccgttttcagcgatgccagggtgcagaccgtcagcgccgtcgaatccatgccccgggaaaccgtaagtgacgacccggaaatccagagaatctaccaggttggctgcaaaaccctccaggactgcatgcaggaggtcttcgaggacggccccaaacgcgatcgcaggctgtggaccggcgatctgcgcctccaggccctggccgactatgtcaccttcaacgacaccaccctgatcaagcgctgcctctaccttttcgccggcatgaacaccacggatggacgcatctcggccaacgtcttcgtcgaccccaacacccctgatgacaccttccttttcgactatggtctcttcttcatctccaccctgagcgacctcatgaaccatgagcaggacatggaggtgctccacgatctgtatccgatcgccaagaaacagatggatgtggatctggatctggtaggcgatgatggtgaactcaagcttggcgacaccccggtcttcgtggactggtccaatgatttcgataagaccacggccatccacgggatcctggtctatgcgctccgccagttcatcgaccttaccgtcaaggccggcgaggacgcacagccctacgaagccaagttgtccgccctggtccagtacgcccaggaccacctcttcgacaaggagaggggactcttcgcctccggccccgagcacgaattcaacatcgccagccagacctggatggtcctggcccgggtcctggacaaccagggtaaccacgacctcatgaccgcagcggtgcgcgaactcttcccggtcaccggcatcgccacaccctatatgtaccaccatatcgtcgaggcgctcttcatcgcgggtctcaaggaggaggccatcaagctcctgaagtcctactggggcaagatgatcaccctgggcgccgacacctactgggaggccttcgaccccgaccagccggagtactccccctacggcagcaccctcatcaacagctactgccacgcctggagctgcacccccgtctacctgatcaagaagtacctgcccatgggcaggtgaaccatcgtgatggtcatgtgctctatcgcctaaaatcagaccttctggattaccccccattaccccacactaaacagtggctgacagagaaattcaaagcatggggccctgaaccaacgcactattcaaaccggcacaaataggaacagggccccttcttttttctgctcagttcttgcatatgtttaggaaatttacacaatcaacattgcgaaccatattctgcttttgttctgtatagtctctctattcacatgtatgcatatgacattagcaatcacattgcattcaagaatcacccatacagaagtgagttctgcacatacttataaatcgctgttgcatcgcagtaggcggtggcttcttcataaaagccgtccttgcaaagttcgccgatctactttgcctctgatacgagctcattcagatgccgaaataactgatccagctcagccttggctgcaatgaccttctatatgagaggacattgtccaagatagaatcctgatgcgagcaggtgcccgttctcattctagctctcataatcaaggggaagcatgtctccagctcggcggaactcgcaagcaaggctgtccctgccgtagagccagaacttgttctctgagtaagcacactgttcatacagctgatgacacttgcggaatggatcatagttaagcagtagtgctccctgtaggttccctaggtaatatcaccttctgataagtaaatttgaaataggtacggcattgcttgctgcaattgtcgttgtctgtcatgctcgattcctccgtgcgcttctcccgaaccagaggcacaaccgtgcgaaagagcaccgccgatcgtccagaacgggaaatcggttctgtcacaagcagccgctctcgtggacaggcgttgctcagccatcatcactacagcagcacgagtcacctttgtgcgcttgtgtaaatgaccgtaagggtgggcagtttaccggcatgcttgaatcagttcaaactttagttgtcaccaatcattatgtcgaaagcccaaaaatctccacgtaatagcaaggattaaaatcatcgaaacacatccatcccacagctgtggaaaacaggctcaactacgtcatagacatacagggcacaaacgtggcagagccattctcaattttgatctgccagatttacgcatcgttgtagttcatgcactaacttccaacagtttacctgttttaccatttaatacaccctagagctgataaaaggtgctctgattcttgcaagtcaatttcatcaatgttggaagtgtatgttagctatcttcaggtctcttctgatcaactgcctttgttgccaggggggggggggcatcaggcactggaaaacttgagagaacgcgcaaaccagataccgtcggtaccaaattagacataaaagtggtcgccatcaaaagcaacgggcgtatttatcatcaagttattcagcgtaaaggaaaacagccgtttcgcgatgtcctatccccatcaaggtcaaactaacgaaacttcaaaaccaaaaaagggtacgaaaatgaccgtcaaataattaattggataaaaattcttcccctccccgatagattctgaagcctcatcgcttttatcacaataatctcagtaacggcactttcccactagctatgtcgattcgaattacctttcagcactactaaagattgagaagatactcattcaatttcttcatgaaattcaatggcctgccgaaataccccttgaggatgtaccaatataatatagatgtttttcagttacttctcaatggccctcagagaacattggagagggggctcagtagtccgcagtatctagctgattatgtcttaggcgaatacgaggcagtcggcaaggggcagaccgatgaaatcgcccgtcacgaatggcaattgcggaaccgaggatctcagaaatgacattgccgaaaattgtgtgcaaatacctacagacactgatgctcgtgggtccgagagagactccaatcgtaaatgaaagacgcaggacatcaatggcgagagctgctttccgagcaacgggtgggattccaatactaaagatatgagagaagttccataaaatggcggggaaaggaagtggataagaatatagaggagtggccgccaatgaaagaagtgcaggaagacctcaaagcaggccgcgagagcaatatgcaatggaacaaagtaacttgcctgccggcaaaatcggacgtctatggaagtccaagctcagcgagatcgacgaacacccccggcaacaacacagaggatattgaggaaaactacaactgaccagttggcccagacagatggtaatactgtcggttatacaatattgaataaatggaaagccgttgcaactgtacagcgggtgcggagagacttaatggacaatcaggagtacaactcaatagtcagcttcatatggggaatcgcggatgattgccttcgcgatgtgtacgttcgcggcaaataccgtgatgtcatcctcccgatgacagtcatccgtcgccttgacgcaatgctcaaggaaacgaaaccagcggtgcttgaaaggaagaaacaactggacgccgcgaagatcgacaatcagtggcccgcactgtgcaatgaagccgggcaggcattctgtaacgcatctccattcctgctaaaggacctcacaagtcggggaaagaagcagacactcgaagcggacttcaaggcatacctggacgggttctccccgaatgttcaagagattctcgacaagttcaagttccgcgaccagatcagaacgatggtcgacgcggacatcctcggcgcggtcatcaacaagttcacctcagcagatatcaatctcagtccgaatccaatctataaggacgcggagaagaagatcgtcaagctccctgggctcgataaccatggcatgggaaccatctttgaggaactcatccgccgtttcaatgaagagaacaacgaggaagcgggcgaacactggaccccgcgtgacgtcgtcgaactcatggccgatttggcattctatccggtcaagaataagatcaaggacgctacctattcttgctatgacggggcatgcggcacaggtggaatgctcacggtagcgcagtcacggctcctgacgctcgcgggcaatcgcggcaagaacgtctcgatccacctgttcgggcaggaggtcaacccggagacatatgcaatctgcaaggcggatatgctcctgaaaggcgacggtgaggaagccgagcacattatctatggatcaacactgtcgttcgatgggaatccttcacggcagtttgacttcatgctctccaatcctccctatgggaagagttggaaaacggatgctgacaagatgggtggaaagaacgagatcctcgacacccgcttcgacgcatatctttcggatggcgaagaactgaagatgattccgcgcacaagcgacgggcagctcctcttcctattgaataacgtgtcaaagatgaaaacggacacagaactcggcagccgcatcatcgaagtccataacggctcgtccctgttcaccggtggcgccgggagcggtgagagcaacgcccgtcggtacatgattgagcacgacctcgtcgaagcaatcatcgcattaccggacaacatgttctacaacaccggcatcggtacatatatctgggttctttccaacaagaaagacgaccgccgcaggggaaagatccagcttatcgacgcaacaaacatgaaatcctcgttgcgcaagaacatgggcaacaagaactgcgagtttacaccagagatccgcaaggaaatcgtccgcatttttctcgacatggaagaaagcaacatcagtaaaatcttcgacaacagtgagtttggctactggaacgtgacagttgagcggcctctacgcctccgagtattcccggagagagagattccggaaaacgccttcaagaaacaagctgatttggacactatcaggaaagctatatcaggtgttcctgtaagtacaccacatgatgattgggatacctttgctgacgcaacagagcttaagaaaacgcagctgaagaagatccgcccatatatcacggaaacggaccccagagcgaaagaggtagaaggggaatccgatcaggaactccgcgactctgagattattccgttcaactatgagggcggcatcgaggccttcatcgataaagaagtcaaaccctatgctccagatgcctatgtagacaagagcaagacaaagatcggctacgaaataagcttcacgaagtatttttacgagccggtaaagctgcgtgacatgaaagacatcctcgcttctcttgctgaactggaaaaggaatcggacggtgtaattgacgagatcataaaggggctgaagtgatgacaccattcgcccatacggacagatggtcttctcaaaggcttggattactgtttcaagagcagaaagaaaagaacactgacttttcaaggaagactgcactaaaattcgtctatggatcgatagaagaaaaaccagaatataagattaatgcttcactcgtggacacttattccaagtatacaaaagttaataccggtgacatcattatcaattgtttgaacctgaattacgattttgcctctcagcgggtcgcgattgtgaaagaaaatggcattatcacttctgcatacatcagcctgagggcaagaacttcggaagttaatcccacatactattgttattacttcaaagctatggattccaaaaagatgctccatggaatggggacaggcattcgactgactctttcttacaacgaattaaggaatatatctgtccctgttccttcccacgcggaacaggaccagatcgtgcgatttctcgactggaaggtttcggagatccggaaaataatattgtctaaaagaaattcgttgcacttacttacggaattaatcaaaactgcgtttgcttctcttattgctgagtcaactgagaaagtgcggttgaagcgagtggtatcgcttgataacgattttatggaaattgacccaaatgattattatcagaaagctggtatgtataaccgcggaaggggaatcttcttacgcaaaccagttaagggctctgacatgggtgattctaagtttcaacacatctatagaaaccggttgatgatcagtggacaatttgcatgggaagatgcggtttttgtcactgacgataaggatgagcaaggactagcttcacatcgatattatctattgaaaagtcaaagtactgatgttccggtggaatacctatttggatattttatatctcaaaaaggactggcagatttgcaaatatgctcgcacggttcagcaggcagaaatcgccctctgaacataaatgagttgctcagagtcgaaattccgatagtacataacacagaggcaatttcgagattttgtaaactgatacgttcatatataaaaatgcgcccattggtattaaaagaagaagaaacattagaagagcttcaaaataagatcattaccgatgtcgtcacaggaaaaatcgatatccgtgatatcactgttcccgaatatgaacatgctgacgatatcatcaagaacggaaatactgatgaaaacaataacgctattgatcaggaggcgtaatcatggcctttacagataaaactgaagaaggctttgagacgattattgtgaactggctcgtgggccagaatggctatgagcaagggacgaatggcgactacagtaacgagtatgctctcgacgagacgcgtcttttccgctttctgaatgacacacagccaaagaagatggaaatgctgggtgtgaacaatagtgaccagaaaaagaggctgttcctcaaccgtctctccagagaaatcaccaagcaaggcattatcaaagtgctgcgcaatggcatggagatgtaccctgcgaaccacattgagctgttctacctgacaccgagcgagaacaatgggacggctgaggagctgttccagaagaatagtttcagcgtaatacgacaactcagatactcttcggatgctaccaaacttgctctggatctgtgtatttttatcaatggcctgccgatcatcacgattgagctcaagaaccatttcaccgggcaaacgacatcagatgcagtggagcagtacaaggaagatcgaaatcccagagatatcctcttctctttcaagcgatgcatggtacatctcgctgttgatgaccagacgatcatgttctgcaccaaactgtcaggcaaggacagctggttcctgcctttcaacaagggctacaatgacggagcaggcaatccaccgaatccggacggcatcatgacggactacctttggaaggacatcctgaccaaatgtaaactctcgcgcatcatcgaaaactatgcgcaggtagtggacgatgaggaccatgacacgaagaagaaaaccgagaagcagatatggccgcgctaccatcaattggattgcgtggagaagctgctggcagatgtgaaagagaacggcgtcggcaagcggtatctcatccagcacagcgcgggttccggtaaatcgaactccattgcatggcttgcctaccagctgattggactagagcagaatggtcatccgatgatcgactcggtcatcgtcgttactgatcgcaagatcctcgacaagcagattcgcgacacgattaatcagttcatgcaggtaaagaacaccgttgtgtgggcggagcattccggcggcctaaagaaggcgattgaagatggcaggcgaatcatcatcactacagttgagaagttcccattcatctcgcaggaaattgggcaggatcacatcaacaacaagttcgccatcatcattgatgaagcgcattccggccagagtggccgaaacgccgcgaatatgaatctcgcgctttcgggcatggcttctgacagtacagtggacaacgaagacaagatcaatgccattgtcgaggggcgaaaacttgtgaagaccgcgagctactttgccttcacagccacgccaaagaataagacagaggaagttttcggcagcccatacgaagaggacggcgctatcaaacacaggcccttccacgtctatacgatgaagcaggcgatccaggaaggcttcattcttgacgttctgaagaactacacgaccgtcgacagctggtacaagatcgctaagaaggtcgaggacgatccgatgttcgacaagaaacgcgctcggaagaagctccgttccttcgtagaaggcaatccggatgtcatcaccaagaaggccgccatgatggtggatcatttccacgagcagatcatcgccaagaaaaagctcaacgggaaatcacgcgctatggttgtgaccgccagcattccccgttgcatagagacctattactctatcaacaaaagtctggctgagcgtcacagcccatacaaagcaatcattgcattctccggagaatgcaagtacaacgggcaggagcccgctctgacatcttctgaaatgaacggattctctaacatgaagataccagaggagttcaagaaggatccctataggcttcttgttgtcgcggacatgttccagacgggattcgacgagccattgctccagacgatgtacgtggacaagccgctctacgatatagcagctgtacaaaccttgtccaggttgaacagagcgtgcccaggcaaggatgaagtctatgtgctggattttgccaacaagacagcgacgatcgaggaagcgttctcgaagttctaccggactaccatcctttccagcgaaacgaacccggacaagcttcacgatctgataaatgtcatagaaagctatcaggtatacgacagtgatgacgtggaacacgttgttgacctgttccttaacggcgctgagcgggatcggcttgacccgctgcttgacccatgtgtctccgtatacaacgagctggaagtggatgatcagattgagttcaagagcgcggcaaagtcatttgtgcgcacttacggattccttggttccattctcccttatgggaacgtggagtgggagaggcggtccattttcctgaacctcctgattccgaagcttccgtcaccgtgcgagggcgacctatcagaaggaattctgtccgcaattgacctggacagctatcgcaatgaagcgcagggggcggtagatatcaagcttgaggacgaggacgcggaaatagacccggttcccgccgggatagtgggtcatatcaccgaaccggagttggatccgctatcggagattatctctgaattcaacgacctgttcggaaacatccagtggaatgacgcagacaacgcgcaaagacagatccttcagattccgaccatggtatcgcgagacaagaagtaccagaacgccatgcgaaattcagatgagcaagaggcccggaccgaaagcgaacgtgccctacagaatgtcatcttttctatcatgtcagacaacatggaattgtttaagcagttccaagacaattcatcattcaagaaatggttgaccaacatggtgttcaaccagacatacaacaagcaaggcaaaccactcgaagcgccggacaacgttccacaagtagaaaggcaaaccgactaaataccggtgttcccaagagcccgtaaactcgtatagcacggttgctgaaggcaaaaagacgcctacggccaaagaacgattctgagaagagaattgagacccgccgaagcaggcgggaagcaagcgaattagagttatcacagcataaatagaccaaaactcaatgctcgcttaaccaaagtgaaggattccgaggaatgcttcacttgagctctatgagaccccccccccaatctcaagaacggacacgttaaaacagcggactctgaaagtactccacgcctagcatcggtaatatctctcctagcctgccaatcagtgagacgagaagaatactgacatctcaatcttgtgacgaagcaaacgttgagggcaatgagggaatggaagcccctgccattcagcataatcaaactgttcaagtgttataaggggtaagtaggcaaagttactagactatttgatccctatcccctctattggtcaaccacttttagaagaacaggagcagaagtactttatctacctcttcgtgaacactctcaggctgcagacatcctcaacagcttcaatgacttcgtaggcaccgagatcaataaggctgtctcggcaagcccctccctgcgcaacaagaaggacctgatcgacgatttcgtcgacacagtttcgatgaaggggaccgtggatgaccaatggcgggagttcatcgaccatagacgcgatgaggaattacagaccatcatcagagaggaaggactcaaactccagccgactgaacggttcatggacgaggcattccgcgatggattattgcagaccagcggcacggcgatcaccaccattcttccacctgtgtccaggttcatctctcaaggcggtcatggcgaaaagaagcaacaggtaatcgacaaactatccagattcttcggacgattcagaggattaggggaaaaccaggactagtcttttcaaacgcggtagattccgcgagacaggcctggaacggctgcgcactgattttgaacacaccgtcataccactgttgccttgagggaaatcgggattcggtcattcataacactgcacaagcgctcaaaccatggggaataaaaatcgactgatgcctcttcggtcacctatcatgtccaactcacgattcaggcccgcatacgggcaaccctccaatattgctcgataccgaatagctgtaatcaatcgtcgccttgcccaatacccagatgatcttggaccaggccttcctcgggcataatcttcaaaccgagtgtttcactgcttctccaacatgccgagatacacctgtatcttctgatccaggaagcccatctgctcctgcaattccttcatcctggcctcaagtgcgccacgatgcttgtagagcatttccagacgctgcggaacggttgagtcgccctcatgcctgagtcgggcatactcctgaacctgggccaggggcataccggtcgccagcaatctctggacgaaggctatccacgccaggtcctgctccatgtagtcccgataccactccggcgagcgcccgggccggatgattcccctccgttcgtaatatcgaaacgtggatatgggaagccccactctttccgatacctgcccgattctcatgttcacctccacttgccctgaaccatggttcatactttacgctcagaatcattcaatcttctaccgaaaaggagcaggctatggcggagtcacgattcgagcgaggttcaaggatactggcatcgatcgatggagagggcggtcaggcggttgtcgaatccctgcaggacattgcgcccgacctgggcaagtggatcgtcgagttcgcctttggcgacgtgtatgccgacccgaccctggacgcacggcagcgggaactggtcaccttgggcagcctggtgacccagggagataccactccccagctcagggtgcatatagccgctgccctgcatgtgggcctcaccaagtcggaggtggttcaggccgttctccagacggctccctatgtaggtttccccagggtcatcaacgccgtcaacgttgccagggaagtcttccggaatcaagaggccggtgacgcacccacccaaagctgacggcgaccccggtcaccggctacagtactggtcgaagaagttgccgatcagttggtgtccgtattggctcccgatgctctcggggcggaactgcacgccctccatggggacacgggtgttccgcagtcccataacgtacccgtccaggagggagcgggcgctcacctccagatcggatgcggcttcggacgaagcctcatcggcgaccggggagcggtagcgggtcacctcgaaggtatcgggcagccccgtgaagcaacccttcccgtcgttcctgatcagactcaccttgccgtgctgacggctggaggccctgaccacgtcggcaccggcataccggacgatggcctgcatgcccaggcagatgccgaatacaggcttccggcccgccacccgctccaggacctccaggtaaccgcagtcctcggggcggcccggaccgggacccagaatcaccgcatcgtaggcaagcggatccaccccatccaggcggttgacccgaacgatggtcgtatccacgcccagcaggtccacatagttcttgaccacatagacgaaactgtcgaaggcgtcaatcagcaaggcgttcatgggccaactcctttccactgatggccaggtaggccgaactcatcttcttcatggtctcctgccattcgctctcaggctgcgaatcctcgacaatcccggccgaggcacgcaggtggtagctgctcgagtggataggaggctgtccgtatgcagagggcggtcaggaccatcccgtcgaagcccaggaagcctaccgaaccggcgtagagcccgcgggagctgacctcggtctcctcggtaatctccaccgcacggaccttgggggttccggtcatggtgccggccgggaaggcggccgcgaaaaacgtcgtacttgtccaggccgggccggattcgaacgaccacatccgaaaccatatgaatgacgtgggagtagacttcggtggtcatcaaccggtcgaacttcagggactccagggtgcagcacctggccacatcgttccggcccaggtccaccagcatcaggcgttaggcccgctccttggggtctccggtcagctgtctgatggccgcctggcgcgcctccccctcaccaggattgccgaccgtcccggcgatgggccgcaaggtgatgtcgccgtcaggggtcagtccgatgaaaagctcgggactggcaccgatgacatgcacaccctgtggggtcacgaagtaatacatatagggcgacgggtcctggtgccgcaggcaccggtagccctggaagggcggaatccgggaatccacctggatctcatgcccaagttgaagctgatacacatcgccctgggctatatgctccttgcccttggcgaaccaccgataaaagcggtcacgatcaatcgtgtcatgggcactgtatggatagtccggcccaatcccatccgaattcgcgtgaccggtcaaaccaaaatcggcaacccctgcgtgctcgaaatcatgcgagcctgcaacttcttcagcgagcgcatcggattggagcaaccccagtacatcctcaagcagatcggattcgcgaccggaatcctccctgccggtctgcgcgtcgaatccgtcgcacgcttccacagcattgcggccatccatttcaccctccgtggcgcggccatcgtcctgctgaccattgcaggcgctctcccgtccgcctcgctcatcagagtcgtcttccaggtgaatcacggtggcggaatgcccgccggccttcagatccaggttgatgatcccccggtagagggtcagcgagatgacaggcagggcggcatccctgggtatgcgctcctccaggtcctcaatcatgaagatggtgtcatacccgaagcagccgaaccagcccatcccgaaaggccctgcatggccaccgctgatgacgaaggaggactcgatccgcctcagcaccgcgaagatctcctggatgtccgggaccgggtggcgaatcaccccctgctcaatctgtccaaagggctccaggacgctggtcagctgaccattgcccagggggtcgatggtcatgacatggtccgtcacgctcagggtcaggattggctcgaatccgatcacgggacggttccggtccgggtctgggccgctcagggactccaggaggaagagctggtcctcccggtacctggttcgcagacgcctgtagatggccagggcgtcaaggtcgctggcgaaccgacgggattccatggatgcgttgatggtcataccgatacttcctttgtcggatgctgcggttcgaaaacgggaatggaccttcacccggtgccgaacgtacccagaccaagccagctatacggcgttccaggggatgaatcatccgttaggtcatgcccgcagctgataagaaaagggagcctcaaaaatgagacggatatgcgaatcagaagaagaaccgaatcggttctggcccttcaggccggaagcatcaacgccatcaagcatcgacatagaaaaagacacccttgggcaaccagacctgccgtgatgtcgctttcttcatgggcaccatgctagagcatgcggatgcctccacacaatcgacatccaccatgcggacttaaccctgtccgagcacttccaatctggccgcatagcagtatcctgaaaagcatcaggcttccgcgcaacacgtgcgcatatacaaagaagaacccatgcaacccatgtccgcattcaccacagacctccagcactcgggcataatcgcccggaatctggatgagaccatcgctttctacactcggaagctcggcttcgaggtggccggcatctttcccaaaggaaaaaaccgatgcgccttcctgcggtacgggcatctgaccattgaaacccgggaggggaggaggctcccatgatcacgggagccatcaaccacctggccttggatgccacggatatcgaggccgcctaccggaacgcccaggagttgggactggagatcaaggaggatggcatccagtccattcccgctttctggaacaagggcatccgctacttcaacatcttcgagtccaacagggaaacaatcgaattctgccagattctctgaacccgaccgcgatcagccgtgtcggtgcgtggtaaatgctacgcataatcgcctgcaatactctcaaaagactgaaaaacagcggatttccaacttaacgcgacgattattcgaatctggaataccactatcattgttggtgtacccaacggggggtaccaaccaagaaaaagattcctcataacgaacattgcgaaagtcacagtggccggcggtggtgttgccggggagccagatcaccttccaatcagccttcaagggcaagaaagttaccgtttacgagatcaatgacgacgccgttgcagcagcggagaagcgcatcggggccaggtgggatgcctataagcacgacgccaatgccaccgacgaacagttcgatgccggtctgaagaatctgaactacacagctgatatggccgaagccgtcaaagatgctgacctcgtcatcgaagccgttccggagtaactgaccatcaagcatcacttctaccagaacctcgccaaactgacgccagtagggaccatcttcgccagcaattcatcgacctatgcgcccatcgtcttcgcgccggacaccggcagaccagacaagttcctcaacctccgcttcgccaacaaggtctggctctacaacaccgcggaaatcatgggcaccgaccagaccgacccccaggtcttccagacggtcgtcgaatgcgccaaggaaatcggcatggttccaatcatcctcaagaaggagcaaccctgttacgttctcagcaccctgctgattccgcttctgaacgtggcaggttacctctggggccacgacatcgccgacccggagaccatcgacaggacctggatgatcaccaccggagcctccaccggccccttcggcatcttcgatacggttgggctgcgcaccgctttgaatatcacaacggaacagcagggcagcagccctgatttcaagccgttcctggacaaaatccaaaagataatcgacgcgaataaggttggcatcgagacaggccagggcttctaccagtatccgaatcccgagttcgagaaccccgacttcctgaaagcctgagagtcatcaggctgctctacctatacgtcgagttccacaggcttctcacgggaaatctatggaactcgacattggtttttcgcgagtcctaacggccgtcagaggacagtggaggccacgatgtcgcggtagaccgcggcgcttcccttgggcttgcggtcataggtgccgttctcgcgctcaaccgagcacagcccgaagtgaacgtcgaaggcgctgatccactcgtagttatccatgagcgaccagtggaagtatccgagtacgggcacattgtcacggaccagctcgaccaggggcggaatcgaagccttgatgaagcggcagcgcaggtcgtcatccggggtggagacgccatgctcggtcacgacaacgggaagaccggtcagatgatggatgtaggtcacggagttggccagcgactcgggatgaagtggggagccgctctcattcacatcctcgccgggctgagccggaatcggcccattgtcatcgaagacctcacgttcgtagttctgcacacccacgaagtcgtcaccctgtactgctgcaggccagggtccatagcaggactcacgcttgtccagggccagctccttgcccctttcggtcgagtaactctcgtcgatgactgccagggagaggcccacgggtagggtcgggcagacggaacgcaccgcttgaacggctgtgcggtgtgcgcgaatgaagccatactccagctgggtgacctcttcgggaatgacgacgttaccggaacgataccgcgcaacgccggccttcttggtggctgcatcgatgcaggcacgctgcaggtcgaccgcctcctggggcagactgccattgtcgaggatacggggcaggtccggctcattgaaggtgacggcaaggacggcacgatcaccgatacgatccaacacacgtacgcactcgtcagcgaacatggagggggcatcatggttcagccagccgcccttggccgcaaaccagctgggaagggtgaagtggcacagggttatggccgggtcaatgccccgctccaggcagccgtcaaccatccggtcgtagtggtccagggcggactggtcgatcttcccctcttcgggctcgatccgggcccactccacggagaagcggtaggaattcaggcccatccccttgaccaggtcgaggtcatcctcccaacgctcccaactgttgcaggccttgccggcaggctctttgaagacgctaggggtcacgccctccaggaaggtggtatcggctgcggtatcgccgccatccacctggtgcccagcggtcgaggcaccccacagaaaatgatcgggcagaattgctgtcatgtgattgctcctttttgtttggttacagattgggtctatttcttgttggggaaaccgcgcgatacggtttcgcctgttgtcctttcggacagaaacctcttgcaggcctcaacgatgtcgccggccccaggcacatacccctgctgggaagcgacctcgggtaggaggtccagacttgcgcccaaccaaggttttgcagccttggtgaaggcgacatccgcctgatcgccctgatagatgggcgacccggaggcagtcagcacctggaccagaccggccatggcctcatccgaatcgataaggtcacggatggtacgaatcagtcctaggcctgggcagacctggctactgggcaggtcccaggaatggtgcccatgcgcccaggcgcgttcctcctcacctggcagggacaccctggcttcgacgccgaccggtatatccaagtcgagatggacggtatccgcatccattcgccaggacagggccatcaacccatacggggtctgctggctcatgtcgatactggtcagggccgcatcgaagaccggtgcgatgcggaccttccgccaccccggctcctccattgccactccggccagtccggcaagcatccaatgcacgatggctcccagggcatagtggttgaatgaggtcatctccccagggttgatggacccgtcaggaagcatggaatcccaacgttcccagatggtggtggcacccatgctcactggatagagccagctcgggcagtgacgctggagcagaagacggacggccagatgaggatgcccgctcctgaccagggcggggcagaccaggggggcccccaggaaacctgtggagatgcggaaaccgctgacccgcacgatgtccgccagccggtcaccggcaccttttcgctcttgcggggtctccagaagatcccagaccagggccatggcatagaccgaggcgcaatcggagaggatggctccattgtcggtgacgtattcgtggcggaaagcctgagccaccttgtcggccagccggtcataccgcttggcctcatccgtctgccccagggcagcatgggcccgagccaccaggcgggtggaatgggcaaagtaggccgtagccaccacgtcgggatcggccttggaacccccggggttgtccggcggcgcatccggatccagccagtcaccaaattggaaacctccccgccagaggtaggagtcgccgcatcgagcctccaccccgtttacgaacccatccatcatcggcaggaaccggcgcagcacaccggcatccccggtagaccggtaaacggcccagggcaccagtaccgccgcatcaccccatccgcaggtcagcttaggaccgtccagcacatcggggactaccaccgggatgccgccgtcctgcgcctgagcctgggccatatcgaccaaccaggaggagagaaaaccgccggcatcgaaaagactgagcgcggtgggtgcgaacatggcgatatcacccgtccaacccagccgttcatcacgctgcggacaatccgtgggcaccgtgatgaagttatccatggtggaccagcgggcgttctggaacaggcgattcagatcggcatccgaggaccggaaggtggccaggggctccatccgggccgaaaccagacaggcctgcaggtcctctgcccggaaatcgtcaatcccctccacctggacatacctgaagccatgctgggtgaacatcggctccaggtcttcctcctgaccggagaggatgaaacaatcagtcgccttggcattacggaggggccgtgtgcccagctcgcccttctccaggacctccgcatgcttcaggaccacacgctgaccagcatgtccgctactgacatgcatgcggacccagcccgagagattctgcccgaaatccacaattcgtttccctgagggggtgacgatgatctcctgtccgggcaggcggtcgacgatctgggccggagcggcttcctggggcctgattcgggacgacggcatggggagctctcggacaggataggtctgtccctggggattcagaaggggaagacgcatatcctgggtctgaccatcgtaaaggtcattggccaggatcgaggacgaacgccagttccaggcctgatccgtcaccagagtatgttccccatccctgtcatgccagagcaggttggccaggacccaaagagcactcccgtagacgtcggtacggcaggtccacgaaagctgcccgcggtaccagccattgcccagaatgatcgccagctcatgccgacccggcgtcagcatgtgggtcaggtcataggtcagggcgttcaaacggtgattgtaatcggtccagcccggagccaactggtcggacccgacacggcgcccatccaggtaaaccacgaaaataccccctgcggtcagatccaggcgagccaggtcgcagtcctcccccaccatgaaatcacgcaccatgatgggagaggcctcttcacgaccgactgcaggattaggggtaatgggacgaccgccccagtcggcattgtcgagcagaccggtctccaccatggcagggtccgaccaggccgaccagaccccgtcaccacccgcgacccggacccgtacacggcaggcctgatgcgagcccaggggactgcctggccaagccacacagacctgattggaaccctccaggtcgtacacctccgcctgggtatgacccgacgcgatctccacctgggccctggtctgctcccaaccctcaggggccgaaagaaccttccaggacagggagggccttgcatcctcataccccaaaacctgttcgccagcttggtgcaaaccaaaacgcgccttggaaaccaccaccgatgtcatggccgcctaccttccccgttccgtcggaatcctacttgacgcccttaataagcggcatgatcagaacactgcagaggctgagtattgcaccaatcagccagagcagggggtagttgttgccgcttgccatgttgatgatgaagggagccaccgccggaaccagaacattggcaccgttcagggccaacccgaagacgcccatgtccttgccggcgtccttgctctcgggaagaaccgcagcgcaaagagccaaatcgacagtcatatacatggcctggcccacacagaatatctcccaggcaaccaggaactgggtgaagctatgggaggagcccgccagaatcagggcaaaggccataataacggcggccgcgatcacgaagggcttcttcctgcccagacgatcggtgaggaaaccagagcaggagaagaagatgaccgagatgggggccgagcagagggtgagcagacccgccttgttacccacctggttcaagggggtgtgcaggccggaaatcaggtaatacacgaaataagtctgcatggaggccatggccaggcccaccaggaagcgggacaaccaggtccatccgaagttcgggtgtttccggggattaacaaagaatccaccgaagagcttcttcacgctgagcgagggaacctcgctgcggtccttgaccggatcgcggtacatgaggagcagcggaattgaggcaatcaaacccagcaggattggtacggtcatcaggaggagaccattaccgaccagggcacctgtcaggtaggtaccagccgagaaggcgagagcaccaaagaggcccatcaaccccatgaccgtgccgcgacgattctccggcacaccctcaacggcaatgaccgagtaggcattgaaaccggcctgcatagccacaaccgaaatgacgtaagcggcacccatcacccaggcgttatccgacagacccaccaaggcggcggtcaccaacgaaaccaggaggcaaccgacaatccagggacggcggcgaccgaacctgctggtggtcctatcggaaagacctccgaccaggggaatgacgaacaacatcagcagggagcccaccgaggttatacgactgtaaacggcatccttctgttcgggcatgacggctgccacgcgcagggaaagtgccgttcccagactcatgcacatgatgtacaagccgacagcggcaatcagcaccaacgcgatggtcttgccggggctgggatactcgggcggcagatagcccggatcgtggtctgtcagaccactggcctcaagggtctgactgtcttgttcagtcatgctggtcctcctttggactgtaaaaacctgtattccccttggtgcatccgaacggggattctcaacgaggattcagccgacgcggcttcgtgcggaaactcgccaagcgctccttccgattccgacttcacaagggttactattgtttttatccacctctcggcccggtcgaaaactcaacttccactcaatggaaaagtcattggaaagtcctatgcccattcattagcatttcccatagtggatatgggagcatatggctatggcagcaactcaagattccggcaaagtcccgcggagtggcgtacttaagcgggctttcgccatccttgactgcttcacttccgaacaaccgacattgaccctgacccagatcatgcaacgcactggcctcccggccagtaccacaagcaggctgctcaaagagctgaccaccagccaggccctgacgcgggaccggttcggagcctactcaatcggaacccggttgatggaaatcgcccagtacgcccaacccatgctcaacatcagggaattggcctcacccatcctcgacaaactggccagcatgacagacgaacacatacagctgggcaccctggatggtctggagatgaccgtgctggacaggcgggagggaaaacacaagataccgatttattaccatatcggtgatcgccttccattggtgcccacggccgtgggcagaacccttctggcctatgcctccacggaaacaatcgacctcatcctgaatgatgagcaattcacctggcccacctggcagacgcccaggcccccagctggtctggttcgtcaggatctggaacgcattcggcaccagcaggtcgcccttctgaaggtcccagatgctgccgttcattcggtcgcctctcccatcttcgggaaaaccgggtcagtaatcgccgcaatcggcatcgtggtcaacgccagcgaacatcagctggagagctacgtgcccatcatcaaggcaggcgcccgtgcgataacgcgtcgcgtcaccagtccgaagccctgcagggtcctgccgccctgggaaggaaactgaagagggcgcgtctcctgaccagagatattcacagcactaatccacccgcgcatggccccgctggatggcattccccacaggcggggctcactctcaaatagctcaaaaacgccaaagcgatacgatccatttgtgtactcatcttcaatatccttgtccttgtaggccgaatcctcagccgcgaacggcccctgccaccatgccggaaataacctgcctgttcaggaagaaatacaggatcagcatcggcaccatcgacacgacaatggcggaataggtggctccaagatctgtctgcccatacatgccgacaaaatcgttcaggccgatcgggagggtcttcatgtcactttgcaccatgagcgtgttggcgaagacgaactcgttccagatgaaaacgaagttataggtcgccacggtgaccgtcgtattgcgagaaagcggcattacgatccgggagaacacctgccaggtcccggccccatcgatacgggcggcctccagtagggaatccggtatctccttcatgtagctatagtcacgaacgcctagacgcccgctatgttaaaagaaatactcctttcgacctgcttagcctctggcgccctaccttcctccaagaccggcattgaggaaagcgcagccatcgcagtccctttacgctaaagccagcattacaaaagccttacattcacttaatacgacataagtagcgtcgcgccaccggaaaccaggagcacaacgacacgggaatacagtttcgcacgaacctataaacaagcgaaaacaggtcatatcctgaacggtcgacttccaacaaattgagcatggatgcgagcggctgcaggtaatacgctcttggtgaggaataagtatcttaggcaagagatttcgtctaatagcagaatgaataaagaacatatggttacacttaaactgtttattaatattcgaaatgtgagagaaagggggttgattgaatgcctagcaaggagacacgggacaagaaaacagcatccgcatggaaacgctggggcgcgcctgcaaccgtggtggtcgtcgtcgcatcattcgcaagcggctggggcttataccgctggaacgttgaaaagcacaacgaagcactgaccgaatgccggcaagcggaaacacggttgaccactacggccaaaacgggggagacgaaactactggcggaggcgcgcatggtgaggacggaccaggtggtcgacgccggtacggtgaccgccttccaaaaagacgctttaccagctgagccggtcaagcctgcgacctgccaagcctcccaagacgagaccgctttgcgggcggcagctgagcgaatggacactcaagccgactcccgcaaggcggccatagccaaggcggagcgggctgcgaaggctgtgttggcttcgcgggatgcgaagagtttggcggacgctaaggccgcgttgaaagcgaagcaggacgagggttcggcgcgtttggcgcagaccgacgggcaggtggccgatgacgccacccgtgagcggctgctgcaggcgttggacgcggcgggcaaggtctcctcctcgaagccgtccgactaccagcaggcgcaggccgccatccaggccgcgctcgaccaggtcaacgccagcgcgcaggcgaaggccgaggcggacgctcaggccgcgcagcagccggccccttcatacggtggcgtcgggagcgcgccctcctaccggcctcctgccaatcgcggcggcggtggcggcgggtacgctccggcgccagcccccgcgcccgcgccggcggcgcacgccgcgccacaaggcggcggatcaagcgctcagagccgattgcctccattagatacaaatcatcatggttgtaacccggatggttcgtgtggtattggctgattgattaagaatgtgccagcgggattggctggtttggacgctacctatcccactggcgttttgaggacgaccataacggtcatccccttcatagtaagggaaagcatatgaagaaactggagttattaaccaatcccagcagggcgaggaagggcgtgtccatcgtttcggcggtggcggctttgatcgccggagtagcgctcgcctgcggcaacaacaatagcgacgactccgaacctatggatatctcgcgacagcggacctacaaggacaacgatgacagaaccgatagcggttacgacacatccgctgtcaatataactttcatcgatatgggtgcagctccttcgacaaccattgtcagcaaggcccaggccacgctgaacgcatccaacaccgattgtgccaagcgattcaacactccgcgcctcgaactaatcgtcccggcagcctgccgtgtcataaaagtgagggcgatgaccggtccgagcagccaattcatccaccagatgcatcatctcaggtctggctgtatgcaaactcgggcgaatacaataaacaggcgtatctacaacagcaacgcctctcaatgtgcaatagccgacacttttaacgaccaacaaggcaagcccgttaatccttcagttctgagttcacattccccaaaaagcacttcagccatcgaatattgtggcttcatgcgtctcggaacgtgcgattgcgcgccaccaatggttccattgctaccatgcccggtgcactgcctccgcggtttctccctccccacccgcgttcggagtgattctggtcttgtccaagagcgtgacgagcaggtaggaaatcaaaccaatggctatgccgaacataatcggccagttgccccccaaagcaaagtcggccttgtgggtcatgccaccataggccatcgtgccagcgactgtgaacgcgctcatgaccaacgaggcgaaaccggctctaggcgagatcctcttgaccaggaaggagaaaatgacggggatgaacacacaaccctacagaaaagcgtacgccaggtcgagcgctttgaacaggtcccctatggccagcgagacgtcgattgtgaccaatccaaccaccagcgctatcccgcggttaatccacgcgtccttgctgctattagcctgattctgcgagtcatgcgaaatctcctccgaaggtccacgacggatgaaacgcacatacaaatcgtcgtagaccaccgtcgagcaagccaggatggtcccggaggccacggacatagaagccgcaagcgccaccgcaagcagcaaccccacgactccctgcggtaggaaagctgagataccagcttcaaacgccatcgacgggtcactgagcttaatgccggcggcatacaccgacataccgagcataatggcggccagtgaatagaagatggcgtacacgccggcagttatggtacccctacgggcaatcttcggagttcgagctgtgaacatccgctgccagatgtcctggccgatcaccaatccaagtaccaagtacatacagtaggacccagtacaaggttcctgaaggcccgcatgtacccagattccagtgactttgcggtatcttgcccataaaccccgtagtgcccttatcttcgggtcggggagtagaaaaaacggtacgagaagcatgactcccagagccttaacacgaactatgaccattcacgaacagtcacaaaacggtcaggcattggaccttctaagggatgaggtgaaacgtctccggactgacaacgcagtgccaaaaggagcgaaatcaccgctcttttgaagcccagacctcggcattggcggcagcagtgggccgggaatcacaacggcgcgcgttcggaccaaggccccggccaacctcaggattgaacggcaggcgcacgatcccgtccgaacgcccgcgcatgattcatttcgatgaccacagggctcccggcgcaggcacacagggaacaccccctcttactcttctcggccgggtcttgcaaggcgcccacgcgcgcaaaacccctcaaaaaaagcctgaagcaggcgcccgggagctaggcctcagtaatgcagcgacatcaacagatccgcgacctgatcgcgggtggcctgatcaatggtggtagccttatccaggatgattttgatttggctagcgacctcgacaacctgatcggaatccgaatcatccaccaaagcctttatctgaagccactctgtgaacactcggtaagctttgtcctcggccttgctctcataagtcaacggcttgcccgaacgctcgatgcggctgagggaatccaaagtctccgcaatcatggtcctcaaggagcgagctgcgatcccccgcttgcgttttttgtcaaaataactctgataaaaggagaagaagagagtggtcagcaccgccgccatctcggccaaccccgtgacccactcggcaagatttcctatttccatgcatcacaggataccggaggccttcgataccgcgaatcccgccatcccggcgccgtgccgcgaaaccatcccctgagcacacggaaccgagacgcgagcggagacgcccaccacgccagggcgaaatccacgcctagagtggacttgcccatgttgcactagaggtgtggaagtgggtttacgcatgactgggcatatcacctgccaaaatgaattgtgaggctgccagagaagcctagctactcacgtaaaggggagaagacaatcatgggagaagggcaacaaacagaaaacgttaaacggcctgggaagcggtgggccattcctgtcgccgccctcgtcgtcgtggttttgtgcgctggcggttgggggattcaccggctgaaaacctctcgtcatgaggatgcggtggcggcgtgccagaacgctgccggccggctgacccgcgcggataaacctataggttcgaagcaactgacggaggcgcgcggggtgcaggccggccaggtggccgacgccaagaccgttaccggctaccagagggccgtgaaagccgtggccacggtcaagccagcgtcgtgcgacgcctccctgggcacgtcggatctgcggtcggctgcggatcggatggacgccgccgccgccaagcgcgaggaccaggacaagtccatcgagcgggctgcgaaggcggtgttggcttcgcgggatgcgaaaaccttggcggacgcgaagtcggatttgaatgggaggagggatgaagcggccaagctgttgggggacagtgatgggaaggtggctgataacgccacccgcgacgcgttgagcaaggccatcgaccaggccggcggggtcaagggcgataaggcaaaggattaccaggacgcggctaacgcgctgcggtcggccatggatcagatcaacgcttcgatgcaggcgaaggccgaggcggacgcgcaggccgccggccaggcggcgccggccccggtcgtccagcaggcggccccggtccaacggtcggccccttcctacggcggggacgggtacgcgccttcctaccggccttccgttaatcgtggcggcggctggtccgctccggcgccagcccccgcgccagcgccagcgcctgctgcgccacaaggcggaggctcgaattggagggaaaggctcaacagccaaaaaccgataggcaatcatggttgtaatccggatggttcgtgtggtattggctgattgattaagaatgtgccagcggggctgaatacttagcaggttcccgccccgctggctaggttggacgagcacgtgtgcccgtccccttcatggtaagggaaagcatatgaagaaactggggttattcagcaatctcggcaaggcgagaatgccgtcaggtggcgaatactggatagagcctgcccaactttatccatctggcaggcgccgccgggcgcaaaccacgtcagcacaccgatgaacgcaatgacgagaaataggatgacgtaggcgttcggcatcgagtttttcttaaccttcctttcagcaggtttgcccgaagccacactcgccatgagtgtctccatcgacttattcaaattccggcgataacgcgggcctatacgcttattaacggcaccctaccgaccatgcggaggacgtgataagcggtaataggtggtcaaattgagggcgcctgcagatcacccagagtagtggccatacctgctttgattgtgcgcgcctgttctcggtctccttaaactggtgaccgtatcgagggctactgtgaaggccgaacgggttcgcgtagatgtcttttcaaaaccatgttcctccccttgaaatagctgtggagaactcgccagcgtttcaggcacttcaactgaattgccaaacgattagtcaattcagttcgtcagcgctgtaattgcgcgttaataatacggtccgcccttgggagtgagaatgacctgtcatacgtaccgtccttgatccgcgtatttcttcttcaaaacactgcaagctctccgcaagcccgacggacgacgaatcaagtaactctaggtcgaaatccaacccgaatcatcttcgggtcgccctcccctccttggctacattcagaccattacggcagacgcatgttgccaaactcaatggggttcacgattcaagagaacacctctccacaacagtcccactcgacggctatgcgttaagtggagagcacaacctagtgtgagcattgtcgaaggtcgccacgttcatagcgaaacccgcgtttcgtagtagtagatgactaatattgggctcctggtatgcccgcagcaccctgtgcctggcggacgagccggaccacgacccccgaaggaagacgacaataaccatgaggaacgtgcttgccatcgtcagaagagacgcgctgcggttgttgcgtgtacctgcggcatgggtgattatgttcggcctcgtcttcatcccgccgctctacgcttggttcaacgtccttggcttctggaatccgtacgggaacacgcttaacatccgcgtggccgtagtgaatgaagacaagggcgccaactccgaaatcatgggcaaggtgaacctgggcggccaaatcgtctcccagctcaagtcgaacaagcaactgggctggcagttcgtggaccgggacgaggcccttgaccaggtcaagtcgggcaggagttacgcggccatcatcattccgcgtgacttcagcaagcagctctccagtgtggtgaccgacggatcggcccgcccccagctccagtattacgtcaacgaaaaggccaacgccatcgccaccaaggtgaccgacaccggcgccgccacggtcgacaaacaggtgaataacaccttcgtttccaccgtctccaaggtggtttccagcgcggtcgacaccaccaacgagaacctcaaccaggcaagtaaagcggccggcaaccaggcggaatccgatctcgcggccttgcagggcaacatcaacaaagcccgctcgaccatcagcgatgtaagcggccaactctcgcaggtgcccaaccagacccagcaggcgcgcatagccctgaaccaagccgacaacctcaagagtgacgccggccggtcgctttcctccatgtccacactgctgagccaggcccaaggcgagctcaacgggttcatcgactcctcttccacgaacctcgatcaagcgtcctcccagctgggccaggccagcgcccaggcaaacgtggccgtctcccaggcgaccggcatgctggccgaagccaatggtggcgtaggttcggcgatcgcccaagccaaacagctcaaccagtcgaacgcgcagatcatcaaggatttagaggacctaggcctgccgaacaccagcggcatcatcaaccagctcaaggctcaaaaccagtccctaggccaatcaatcagggccctggagcagctgaacgcggacaccggcgccaccatcgcctccaccgcctcactagcggacaccctcaaccacgccacccagaactccctgtccgcctcaggcaacgcccgcaaaaacatcatcgccggaaccctgccccagctcaacaacggcttgaactccctctcctccgcctcgggtggcctgggcgccaggctgagctcgcaaggcaccaccatcgcgcaagcgaaggcgatcctgggccagctggatcaggccacctcatcaacccgccagtccctggcctccaccgactcctacctttccgggctgcaaggcaaactgaccaccctctccaccgacatcgacgcgctggacaccgccaacgccctgccccaagtttttggcaaagacggaaagctcgatgcggcgaaagtggcggacttcatgctttcgcccaccgtgctcgacactaaggtgctctacccggtggcttcctatggctccggcatggcccccctcttcgtcaacctctcgctatgggtgggcgcgttcgtgctgatggtcatcgtcaagctggaggtggacgacgaaggcctggacgaccccacgcccacggagcgctactggggccgttggctcctcctagcgcccctggcggccctgcaaggcgtcaccaccaccatcgggaccatactgatcggcgtgcagaccatctcagcccccctgttcgtgctgaccggcgcaatcacctccctgatatacctgtccatcgcctacgccctctcgaccacgttcatgcacgtgggcaagggcctgtgcgtcgtgttggtcatcctgcagattcccggcgcatccggcctctaccccatcgagatgatgccctccttcttccgccggctctaccccttcttcccgttcacctactcaatcaacgccctgcgcgagacgatcggcggcttttaccgcaacgattgggccatggacctggccaagctcggtgtattcgcccttctcttcttcgtcctcggcatctacgggcggccccggctcaacaacctcaatcgcttgttcgcccgcgaaatcgaggactcggacatgctggtcggagagccggtggagcgcatcagcagcgaattctccttggcccaggccctggccgtgctcgccaataaggacgaataccggcaggcgatcgtggcgcgcgccaccagcttcgcccggctgtacccccggctcaagcgaggggccctgatcgccggcatcgtcgtgcccgccatcctggcggtcaccttctccttcacttccggcactatggtgaccgccctggcggcctgggtcatctggattctggtcatcatcgccttcctgatggcgattgagatgatgcgagaccatgtggtgcgccaaattcgtctgggcactttgtccgagcagaccattcgcggcatggtcttcgacttcgaccgcccccgacgcaagattcggcgcaggcggcgggccgccatgccggcccacctgccttcggacgtgaccaatcccgcggccaagcgggattaagcgtgggaagcggatgaggttgacggagcggatggagcgaacagtgctgcctaagcaggtgaaacggatatgccaaaccaggggaaggaagtgaacgggcatgaagtccatgtgggagctcttcaccggtgacctcaagcgaatcacctccaacatcgtctccatcatcatcgtcatagggctcgtcgtgatcccaggcctgttcgcgtggttcaacgtggcggccagctgggaccccttctccaacaccaaaaacctcaagttcgcggtagcaaatgtggataaaggctataaatccgacctcatcccggtcaaggtgacggtgggtgaccaggtggtcaacgagctgcgcgccaacagccagctggattggaccttcacctccaaggatgacgccatcgacggcactaaatccggcaagtactacgcctccgtcgtcattcccgaaaacttcagccacgacatgatgaccttcttctcggccgacgcccaccacgccaagctggcctactactcaaacgagaagaccaacgccctggcccctaaggtcactgggcagggcgccgaccaggtggccgggcagatcaatgagatgttcgccaagaccatcaccggcaccgcgctgtccatcgcctcccagctggcggacgagatggatcggcctgaggccaagaccatgctgacccggttcaccggcaacgtggacgatgtcgccaaagagctgagtcaagccagcgccatcctcaacaacttcgactccctttcccaggacgcgcaaggcctgatgacatcctccacccagatggtcgactccttgtcggacggagccaaccaggccggacgtgacttgcagaacgccaatcatcaggtgagtgacgtgtccggcgcgctcgactccaccgctaagagcttgtcggatgccttggtcgcctcatcctcctcctacgatgcggtgggcagcagcatcgattccaccttccaaactgctaatcattcagtggcggacgcggccgccggcctcaaccgcgagtcccagcaggtgagccagcaggccgaccagtaccagcggatccgcggcgctctggtcgctaccaccggcgagaactcggtctcccagcgcctggacgcggtgattttgcagctccgccagctcagctcctccctatcatccaccgccgcaaacgtgagcaacaggaacgcgcagtccgcccagcagcggcagcaaatcaaggatctggccgcccaggccaaagcttcgatctccggcgtttccagcgatttcaacaccaagctcaggccgcaaatcaagcagatcgcatcctcggtcaacgcgaccaccgccacgctcgggtccgcaagctcacagctcaagagcaccttgagcgggttaagaaccgacaccagcgcggtgaataaagacatggccgacgtgaacgacatgctcagctccatgtcagccacgatggctaagaccagcgaccgcctgaccgacttcaccggcaaactcaacgccgccctgaccagcggcgacatggacacggtccgccgaatcctgggctccaacgacccggagacgctggccgccactctggcggcgccggtcaaactcagccgcacaaccctgtacccggtgcagtcctttggcgcggccctgacccccttctacaccctgatccccttgtgggtgggctccctgttgatggcggtcacgctgaaaatcacggtctcccgccgcacacgcgaagccctaggcgatccaaagccccaccagctcttcctggggcactttggcgtgttcgcggtgatttccctcctgcagtccaccttctcttgcgccggttccctcctcttcatcagagtccatgcggcgcacccctggctgttcatggccaccggctggatcagcggactggtttacgccttcttcatctacacccttgtcgcctcctttggcaacgtaggcaaggccataggcgtgatttacctggtcatgcagatttccggctccgggggcgcctaccccttgcaagtactgccaggcttcgtctcagcggtcaacccgtatctgccggtctcccactcaatacaggccatgcgcgccgcaatcgccggcatctacatgaacgactattggatcgagatcagcaagctcctcctcttcgtgccgcccatgatcctgctgggcctggtcctacgcaagcccctagtcaagttcaaccagtggtatgtatccaagatagaagccaccaaactcatggagtaatgcgctcctctcctcttcctcgttgatttaaatgtacagatttttgtacaatatcgaacgacactagtctaccggactggggaggaggacgacatgcaggccgtagcgtacagcaacttccgcaagagccttaaggcgtacatgcataaggtcaacgaggacgcggatatgctcctggtgaccaacaccgacccagaagacaacgtggtcgtgatgagcgccgatgattacgactccctcatggagaccctacgcatctaccaaaacccgtatctgcgcgataaaatcacccgcggtctggcagcggtagctcagggccaggccagcgaacacagcctggtcgacgacgacgagccggagcgccgggcggcggcatgattctgggctggaccgaagacgcttgggaggactaccgctactggcagtcccaggaccgtaaaaccctcaagcgcatcaacaccctgattctcgacaccctccgccatcccgactccggcatcggcaagcccgagccgctcaagtggggtctccaaggcgcctggtcgcgccgcatagactccgccaaccgcctcatatacaccttcaccgccaccaaactgaccatcctctccgcccgcagccactaccaataagccgcccactgatcgctcccagcccttatatgctgggtttatggacgagggttggaaggctggaccggattggggcggctcggcagaggcgtaaccccacggcgatcgctgagttgccgagcggattcacggtttttgcggatatgcggttcctgcctggctggcgcattctgctcccccaccggcacgtgggctcgctcaatgagctcggcatggaagagcggtctcaatccctgctggacatgtcggtcctgggagacgcgacactggcggtctgccaacccgggcgcatcaactacgacatcctgggcaacaccgacgaatacctgcatgcccacgcctacccacgctacgattaggaaccgcccgaccaccagcccctccccgcctggctctacgaaaaccgctactggtctgaccccgccaccgccttcaacccggtccgccgctgccaactcatgaccgacctaggctcctccctcagtgcacataccgagattggcgccaggagtgcggcatgactgccccggcggaagcagcggccatcgcccggtatagcagggaaagctccaccaggttctcgccaagtcgcgcacgtagatggaggtgatcgcgcgcaatagacgttattagcttacgggatttcctttccttttcaccgcccacagtccgagcaacaccatcgaaacagcgagccgggccagcaggtggggcggattgatgtggccatacatgctgaatccgttaacgacggcggccgcgatcaagcctaacaggccgattggcaggagccagtcccagcgtaaggcggccaggaggcagcaagcgaagaggagtgtggccagaagcggccagaccggcacactccccataagagccaatgcggaaataatcatcagccctgcgtatatgaccaccgcactgacgtagatggcattcaggattctcatactgcccctttcgtgcttcaattgaaacatatggggggggggacccccacagcaaattgcgcagaaaagtcggcgcacaggaagaggcggcatgcagatcggcgaattcgcgcaccggcatcagaccaccaaggacacggtgcgcttttacatggtggctgggctgctgcagcccagccgagcaggccgcaactaagacttcggtccaccggagaaagaggcccttgaagaagacaaatccttaagaggcatgggattctcgatagccaccatcgtcgaaatccatggcaggcatgagactcaatgcggcacccgggaacaacgggaagccaacctggacctagtgaatcgggaatttgcctccatcgcccaacagcaggccgatctcgcccgccgcaccgcctctctcaaaacggcgaagaaggaactggaacagctcctaggctgagccctccatccaccagattcaaggcctgcccggaagtgcgaccgctcgaaaaatccggttagaatagagaggactatatcagcggtcagggtggaccgacgaaaaccaaggagtcacgcgatgaaaccaatgacggcgtttaccacggatttacagcactcgggcatgatcgcctgggacttggacgagacgatcaagttctacacggagaagatgggcttcgagctggtggacaccttctttaacggaggcaaccgctgcgccttcctgcgctacgggcacctgacgatcgagacctgggaaggcgagaccgcgccgatgacgacgggcgccatcaaccactgggccctggacgcccccgacatcgaggccgcctgggccaacgccaaggcgctgaacctgaacatcaaggagaaggagatccagtcgatcccctccttctgggaccacggcatccgctacttcaacatctggggccccaacaaggaaaccatcgaattctgccaaatcctgtgagcgggcgccgagccggcgcacaccccaagaagccgagcccgatcatcgcgatcgtgggacgggaagagcccgcgaaggccattccattccagagggcgacgcccccccccatcattgaggaccatctgatgcgcggcaaggctcagtgacgaccttaagccaggcgcctcgaagatcatgccggcgaggatgtgcggttccatacaatattggggctatcaggggtggtttccacgggggcgagcggatagattgggaagtgcagtagcagtgagtcggcccaacgtcgggccgctcaacgaaaggaagttcacagatgagcttggaacatgtgaccgtaaccggcgggggcgtgctgggtagccagatcgcctaccagtcggcttttaagggtaaggccgtcatcatttacgacatcaatgacgaagccatcgcgcaggtcaagaaacgcgtgaatggcctacgtgattcttataagaacgacattaaggccaccgacgggcagttcgacgccggactcggccgcctgtcgttcactaccgacctggcctcggccgtggcagatgcggacctggtgatcgaagcggtgcccgagcgcccctcaatcaagcacggcctgtaccagaacctggccaagatggcccctgagcgcaccattttcactagcaattcctccacctacgtgccctccacttacatggaggataccggccggccggaccgcttcctcaacctccacttcgccaaccaggtctggaagaacaacaccgccgagatcatgggctcgcccaagacggacccggcgatataccagcaggtcgtgcagtacgcgcgcgaaatcgggatggtgccgatcgagctgaagaaggagcagccgggctatgtcctcaacaccttgctgatcccgctgctggatgccggcagttacctctggggccaggacatcgccgacccgcacaccatcgataagacctggatgatcggcacgggcgcccccatgggcccgttcgggatcatggacctggtaggcctgcgcacttgctacaacatcaccaaggagcagcagggcgacgaccctaaggcccagccttacctggagaagatgaaggccatgctggacgagggcaaactaggccgcgagtcgggtgagggcttctatcattaccccaaccccgagttcgccgaccccgctttcctcaaggcctgacggtccgtccggccgcagcggcgcagcagccgccaatccggcctgcgacccacacacctaagacgtaagcccggcgcgaggttccccaccagcgaaatgctcggaaagacgggccgccgggctttgtcatgcgcggaaatcccagcccccagcccggtccagttggccataagagcgcgattcagacggcgcaagccctgagcgaggcgcagcgagcccccagtgataaactcacacattatgacattgttgtgaagaaagatgacagcccagaggcgaaccagagccagcaagaccaagaccacggccgcaggagccgggaagaaaacatgacagccgagaatactacgaatacccacatgaatacgagccgcgaggatggggccaagcccaacagcccagcggcggaagcggacggagagcccgacagtaagggcgggatgccccgcaagccaaagaaacagaccccatacagcttccgcaattggcgacggcgcctacatgtgagcgatgtgaccgtcgtcgagaaagccacgctcaagcgtgccgtcgcaggcaccgtggtcggtaacttcatggaatggtacgacgtgggcgtgtacggctacctggccatcacgatcggcgtggtcttcctgtccgacgcctcgcccgccatccagcggctcttctccctgggcgtgttcgcggttactttcatagcccgccccctgggcggcatcgtgcttggacaactgggagacaagctgggccgccagcgcatcctggccttcaccctcctgtccatgtcgggcgcaaccctcctgatcggcctgctgcccggctatagcgctatcgggttctgggcgcctctggccctgatcatcctcaagctggcccagggcttctcgaccggtggcgagtacgccggtgccaccaccatggtcaccgagtacgcgcccgaccgccaccgcggcttcttcgcctccctcctcgacgtaggctcttacttgggcttcgcttttggcgcgggtttggtctccctgatcgagttcaacctcagccccgaggccatgcaagcctggggttggcgcatccccttcatcctcgccctgccgctggccgcgatcgcggtctacttccgtaccagggtggaggacacccccgccttccagcaggcgcagaacgccacgacagagaagaccgcggccgagcataagggcgtcatcagcctgatccgcgggtactggagggagctgctcatggcattcgtgctcgtggcggccgccaacacgctgggttacacgctgaccacctacatgcccacctacctgacgaccaccctgcaccagaacatggcgcaatccaatctgttgaccctacccatcctgctgatcgtggccgcttgcatcccactcacaggcgcgctttccgacaagttcggccgcaagaagatcctgttcgcgggcgcccttaccggcctggcgctggtcatccccgcatttgaactgatggaacagggcaccgcgggcaccaccttcctgggcctgctgctgatcgcgattccagtcatcttcttcgtggcgaacctggcctcatcgctgccggccctcttccccaccgcctcccgctatggcggcatgggcctgtcctacaacctggccgtcgccatcttcggcggcaccgcgcccctaatcatggaggccctggtctcagccaccggacgtgacctggccccggcctactggatcatgttcacctccgcctgcggcctggtcaccgtgctcttcctcaaggagtcggcgcgcaagcccatgcccggcaccctgcccacggtctccagccagcaggaggcacgcgacctggtcgccacccaagacaagaacccggatctggatgtcaaggccatcatcaaagacgccgaggccaacggcacccgccaagtccccgaaaccataaaaaccgccgcccgggccatccgcgaaacccagcaaatgtgagacagcgcgaggccacccaatacaccgcaagagacggaagggcggcctctcgctgtatggaacgcgctcgattgcgcgcgcaatcggcccattcgaccccgaccctggcgaacgattcaccttggggcgacgacctggcatatctacggaccgcatcagagggatgcccccgctcaagctgctcgacaggtcccggaagaggccgctgggagcgctcatgcccatgccggcaatagccccctccgattaatacggagtacgggaaagccaacggcacccggagccccaaaaccccacggaccgttaatctggatgaccagccctgtcgctacctcagaaaatcccaggagccttcgcggcgggcgcgcttgcctgcggaaagaatcagcccatggtatccctgcatctcaggcaaggtgtactcgtccacgttgatgaactcccgttcgtgtccgcaagcgccctcgtagctgccccaattcggatacccaacagccgctagaagccgccgggaatagaggtcccagataaagcacttctgcccgaaggcgtagagacggatcacgtcagcggtctcaggtccgactccagtcaccgtcagcaggctgtcgcgcagaccagggtccacgctgggctccacgtccgccgcatcggttgcccgccccagcagccactgggcgagcgctatgcaggtgcgcgccttcgccgtcatgaagccactcgggttgatcagcgtcttgacccgctcgtactcagcttccgccatggcggcgggatgcaggagcccagcctggcgcaaggcgtccaaggatttgcccacgttctcccaggccgtgtgctggaccagcaccgcgcccatcatcatctcgaagctggtctcggccggccaccaatccatccggccgaatgtgcgctgcagagcctgatagagctcgcgggaggtcggtggtgcgggcgagcccgcggcgagagtcgtctcaaatcgttgcttgtccatactccgttagtagcgcattacaccccctaggtcaattcccgcgctcctcgccaatcacccgcacagtacagcatccacaaccacagtgcggccaccgccgcagcattccccgctatgggtatcggtccattccactaaggcatccctgggcagacgaacctcccgcttcctctcacctgcaaccgaagcatggggcaagtcctgggaaaagtggacggcgaatctttacatggggcggttggggaactactctcacaagtatgaccgagacattgcggacctgcccgctgggcgtggacatagagatatgtcgcattgacctgagcagcgcctatcggttccggctaagggagctcggcttccgcgagcacgagcgggtcagggtcattcagaaagccaatttcggaggtcgcgtcatcgcccacggctcggaacgcatcgccttggacggggctactgccaagcacatcgtcgtgaaagtaagctgaggcagacagaccgatccaggttcaagagggaaggatcactatggctgatgacctcgctaaggaggccaagcggccgagcgtagcgacgcaggagacgctggaatcgcgggaaatggaaatggggacgcatgaggcccacgccggcggccaccatcaccgccggggcctggcggtcctgctgcccatgccccatcaccatatgcacccgtcccagaatcggccctccatcgtcttcgtcggcaacccgaacgtcggcaagtccacccttttcaacgcgattctgggaacatcggcctcggtcatgaacgcgccggggacgacggtcctggttgaacgcggccagctcaaccgaggcggaaccagctgggacttcatcgacaccccaggcacagcctccctggacgcgctcagccccgacgagcaagtggcttcggaggcggctatgggccgggccggcaacccggaaccagatgtcatcgtcgccgtcttcgacgccacctccccctccaagtccctctacctgctcagccagctgcttgacttgggccgaccaatcgtagcggcggtgaccatgctggatttggcagccaagcagggctcgtcaatcagtgtggacgcgctcagccgccaggtgcctggcttggatttcattgcggtggacgggcgcaccggccacggcaaggaggacctgctggaggccatcggggcccgtatcgccgccggtgagcaagaggattcgtctggttccctccagctgctctcgccagcgaccgacctgtcagctcccgggcgcgaagccagccaggaggaagtctccgcctgggtgcgcgccaccgccgaccagcgctttgattggacggctcgcgtgctgacggatttgaatcctgcgcatccggatgccactgggcctgaacccaccttctccgaccgcctggacagggtcctcctgcacccggtggccggcatcgtcatcttcctagccgtcatgtacctggtgttcgaggccacaaccgtggtagcagcccccatcaacgactggttcgacgtgaccgtgcgcggctgggccacgagcgcgatcgactgggtcttctccgctttgtccgggcccggctccctggactcctggccccattcgctgctggtggatgggcttttggacggctgcatcaccgtcctgaccttcatagcgccgatgggcatcatcttcatcgtcctctccctgctggaggactccggttacctggcccgcgccgccttcgtgatggacaaagccatgcgctcaatcggactggacggacgcgccttcctaccgttggtggtcggtttcggctgcaatctgccagccctggcctccacccgcaccctgcctgactcccgccagcgcctgatgaccggcctgctgattccgttcacctcctgctcagcccggctgagcgtctacatcgtgctggcttacgccttcttcgggcgctacgcgggcttggccatcttcctgatgtacgtgtcttcgatcctgatcatcctgggcgtgggccttctgctgcgcaagacgcagttcagcgatttaaggacccagccgttcgctatcggcctgcccccctaccagatgccccgcctgatccaacttggcaaatcggtggcgctgcgcctgtgggccttcctgaccggggccagctcaatcatcatcacgatgatcgtcatcatgtggttcctgtccgccatccccgtttcggcaggcgcggccggcgctaactccttcggccatgtggacgacgtgcacgactccctctacggggcggtcgccacctcggtggccccggtcttcaaaccggcgggcttcgacgactggcacgcttccgcggcgctgatcacagggttcgtggccaaggaggtagtggtcggctccatgtcgcagtcctatcaaatccactcttctgatgacgcctccgaccaggagcagggcaccggcaccttgggccaggcggtgcgcgagtccttcgaggcttccagtcatgggcatggctcggcagcggcggcggccttcatgctcttcgtcctggcctacacgccctgcctggccacggtggcggagatgcgccgccagtacgggggcagaatcgcggcccaatccgtagctgccggtctcatcatcgcctacattctggccgtcatcgtcttccaagtcgggcggttcttatgagcgccgggcctgggttcaggaaaaccagccccagcggtgcgtccaagccgggcgaacccggtgtaggcggcgacatgcaagccccaatcgccgagcgaatcatcaacgccctgacagccgggcagcctccccaaaccgtggcgcggaaagtaggggtccccctcgatttcgtctcactggtcaccgagcaggcccgtcgctcaggccgcctgaactactacgagctcgccgccgggaactgtggctccggcccgggctgcgacccagacccggattccctggtctgcgcctcctgccccatcctgccagccgcagtgcgccgccagcagtccccgtgggcccgcctgcgcgcccgcattcgccaatccccctcagaagaccgatgacccttgccggcttttgaatcccacccgtcccaggcagagacaagaccgactggatgaaaccctgagtaacgctagatttctctcgtccagcggaattgactcaaatggcaggatgggcgatcaggtcgcgttcaatccaagccatgattagggcagctagacggtccacctcctgatcggtcagctcgcgccctttgggcacgtggtgccagcgctcgatgcagccccggcagcaggtggccgtagcgtgttgggccgtaaagaccggatgcccgcggtagggggtctgcttgccatccttcaaagggttggcggcgcctacgcgctgacggagcatctcgtgggcatgccggtctatcgtggctttccctttcgccctggcataggcgcggtccttggcggtaagcgaaaaggaggcgcggaactcggacgttcccagccgtctgagcatctcctggacccattcctggcccgcgtactcacctgtgctttcacctggctcgccgctgtgacccatcacgtccatcctctcctcgcctcggcatccgccttctaatataggacggctacatggccgaacgatgcagcttttcccgtaaggcacggcacggtaagcctacggggagtagtgtggagggtaggaagtgttagtgatttggccccgctcctaattactctcaggcaggcgaggctttgaagaggaagaggctatatgaacgcacgcaacatgacggtcgcgcagatggttgaggctttcctggagcctgacgctccggtgcaggtgagggccttcgatggctcgcgctttggctccgacgacgctcccctccacttggatatcaagagttctcgcgccatgtactacatcgcggagaacccgaacgacctggggctggcccgcgcttacctccagggcgatttggattcccctgagctcctgcccggcaacccttacgaggttttcaagcaactgaccggccttaagtcctacctgcgcaagcccggcaaggtcgagctggcccgcatcgccgcggctgtcttctcccacggcgtgcacgtgcctgatccgccgaccatcgaaggcccttccctttcgacgcgcctgcgcgaaggcatccgcccccacacccgcaagggcgacgcggccaccgtcagctaccattatgaccagtccaatgacttctacaggctcttcctgggcccctcgatgacgtacacttgcgcggttttcgacaccccggagacctctttggaagacgcccaggcccacaagctcaacatggtgctcgacaagatgaacctgaagaagggcgaccgtctgctcgacatcggttgcggttggggttccatggagatagccgccgcaaagcgtggcattaacgtaattggcgtcaccttggccgatgagcaggttgagtggggccaggagtggatcaagcgcgagggcttggaagacttggcggaaatccgtctgatggactaccgcgatgtgccggagtccggtttcgacggcatatgctcaatcggtatgatggagcatgtgggcttcaaacagtacccggcctacttccatgagatgatggaaaagctgcgccctggcggcatcttgctcaaccaccagatcacgcggacgaattcgcacgacggtaagcgcgctggcagcttcattgaccgttacatcttccctgatggcgagctcgccagcccagccgagatcgagatgaccatccaagacaatggctttgaggtcatcacccaagagaacttgcgccagaactacgccatcacgctcaagcactggaccgagaacctccaagcccagtgggaacaggcgaaatcaatggtgggcgagcccaaggcacgtctctggggcctgtacatggctggttcccgcctgaacttcgaaatcaacacgattcaggtccaccagttccagtgcatcaagcccgatccagacaccggcactagcacctacccgctgcgcccctggtggacgcggtagccagcagccagcccgaaacgcaaagccccgcacttggtgcggggctttcctcgttcaggctcgcatgccatgagacgctactgtctggactcgcgccttacccgggcctgtctggcatgacgaagccctccgcttggagggcttcgattaggtaatgctagcggcgggattgggccgcgtaaaggcgtaatgggccggctgctataagcaggaggatggtcatcgaagccaaagcttggacattgctgccggtcgccgccaagcgacctgtgacctggggggcggacgatgaggaggatgcgttcgcggcagcagggggagcgtctctgacctgcaccttcggccggatcgtcacacggtaggggtccgagctaacgcccgtatggtcaggtagttgcacgacgactggatcgcctgaggcaatcttgcctgttgggcccgagacaacctgcaccagccaatacgtgctgtacctatctaagttgaaggctgccggagaaccaccgttcaccttgttctgcgaccggtcgtaagtggccccttgcagccatacgccgttagaggccgaggaaccgacggtgatttggccctggccatcggtggtgccgaggtaaatggtgcttttgccgcccgtcttatccacggtatcagagaacttctccatcaccttatcggtgacggccttgttcgcagctgtaccttgaccgttggatgtttgatcatcaacgatgcgctgcatgacggaatagtccagttttgtggcgctgaatatgtagcctgcgccgaccggctttgctccagctggcagtagttgattgatgttgcggggatctccaatgccagtgcccgtgccgttctctgccacttggagggtcaatgcagcgtcactgtgaggctggccgctatcagccctggcctgcgtaggggcaacccctatcgcaatagctatcaacagcaggaaggacaatagccctaccccaactgccgacgataatctcttcagcctcatgttgaatactccccgtcaaaagctattcatcggttccggattcttactcaagtgtctcttctcttacaccggaagccgtttggtaacccaccgctctctccttcagtgggtcccaagccccctgccctaataggcagaagcctcgggaagcggaccctcgcgagtccaaaagccatactgtcgaggtggggctccgcccgcccgtcaaggcggacggagccccactgcatgatcactgctggttacaaggcagtgattgaatctgattcaatgaatcagatgtgacgaccaacagaggcgttcttgcggttgcgggcaaccagcacaccacccatgatggccaggccgataatcaggagcaggatgatgcccttgccaccggtcagaggcaggctgatgggcgcaccggactcaccactcttccagttcatcatacccttggtgatctggtcaccgttagcatccttaatgttagggctaatggagacattgtgagcagcagggtcatatgagccgaagttcagcttggacatgttagggtgcagaccactggggaacgcagcgatagcatccgagacactggccttggacacgacatcaccaaagtcgacgatgttgaactttgtagaagcctgctgatagttcgccggggccgcgatctcaacgagtttgaactggccctggtcgctagaaacacccaccggcagcttgatgccagtgaatgtgacgacaccctggttgttcgaagtagcggtaatcatcgggttagccgattgtccatccgcaccaaaagtaccgtcttgcagcaggaaagtacccgtatcatcgttcttctgcagagcgaacttggctccagcaagaccggtgccatccgtcttcacctttgcaaactggaaaccggcggaaggcatggacgcgtcagcttgactgccagggttctgcctactgtcgttgtaggtatcggtagcgacagagttggacagacggccggccagggaaccatcgccagcaccgttcggagtcaccgtggacctgatggtaatcacaaagcgagggtcgttcacggtaccggtcacaccgctaagcgaagaattcgaggccttcttgaagtggaatacgaggtactgcgaggaaccgtcatccgtgaacatctcgtccgtgctattaatacgggtgggaggagtcgacagcttttccatcgtgtaatcgctatcactcatcaagcctcgggtatggtcgctcgtaccatcgttataagtgaacactacagaaacgttgctagcagtgtcagtgtcaacgctcaaggcgctggaaacacgatcaacaaccctcaggtactcgccggtgtttccagcagattggatgtaattccagtagatgttgttatcgttgttgaccgggctagctgtactgatgttgttgttaatctgccaagtgaccgtattaccggcaacagcggcttcgctcccaggaacgtaatcagagccattgaccttggtaatcgacttcgaaacctgctgggtgttaacgttcttcgggaagatgtgcaggtgatggatgtaacccgtcatggtctgctgggtaccattcacggtgtacttaccggtggtcatgtaaggcagggagaagacggttgtctcggcaggtgtgtaatgattcaggcttacgggatgagcaacctcggacagctcatagtagtgcgtgccagttgcttcgagcggcaggacatcagcgctggtagccggggcgctgccttgaccctgagcccaagccttccagcttgcggcgtcaacaggatctgtggccggtgccttcatccagataccgacagctggattaccgctggccaggttggcaatcttaccgtttgcgtcagtaacaccggcccaggttttgccatctacatagttgtagtttttattagcgccaccgttagggttcatatcactcgggttatgcgaaccggtagccacaatctcacgcagcttgaacacaacgccaactcccacagcggtaccaggcttggcgtccaaggacgaaccagtggcggcattacccgcggcgttagccaggtacttggtcagagtgaccttgtcatgctcgcctgcagctgggtcaaccgaagtggagaactcgtcatcagccgaaatggtgtcagggtcagcagcgtgggcaccaggcgcggcaaccaggaaagccgccgcggtggtgagcaccgccactaggaggccaagcagtcttgcagcaagactacggctcccagtcttatcgttttgaatacgcattgaatgcgctccttttctcttaccttatctatagtgcaggtccaaccgatagttccccatctttcaccgccacgatgcaagattgcagtcagtgccggttagaccccgcgcaagtttgattatacgcatagcctaggcaaaagggcaaataaaaagagccacaggaagcctactgctgtaatgggtttgtaactacgctcctgtgattacccgcagcctggcacgcctggacgccgtcaaatgcaactcacgaattcaagccttcgccgctccgcgatgcttccagaggcatgcgccgccgaaaaccagcagccaaatcaggccgcagacggcggacgctcgcgtgtcctgcgccaggaagagcgaagcgtagacgaacacgaagaaggcgatggccagcgagccagtccaccggtaggccggcatgaggaaaccatccgccacgaagtcagctgaagcgcggtagcggcggtgggtcacgatcagcaagacatagatgaaaataatcaccgcggaggacgctgaggcgaacaggacgaacgcggacgagaatcccggcagcgagcgcaggacgggtgacaagaggatgagcaagccggacaccaggatggccctagccggcacatggccccgcttggagatgacggccaaggagcgcatggcagggttctcagccgagccggccagttggaagaggttgcggccggccgaatagagcagggagttcaaggccgaggccgcggccgttatcacgacgaagaagaccagcgcggccgcccagtccagcccggcgtatcggaagaccatcacgaagggggaggcgaacgtcccgtccgacttgggcttgaaggtgcgccaggggacgatgagcatgatggcgaccaaagcgcccacatagaagatcagcacgcgcacaataatctcgttgatggccttaggcaggaccttgcgcggattctgggtctccgagaccgtgacgccaacgaattcgatcatctcgtaggcgaagaagaccatttggaagctcatgaagaaggagagccatccattcggtgccaaggagaaaccgttcaggatattgtcaatgcccgcgtggccagccggggaggcgggctcggaaccggacatgtggatttccggataatggaagcctatgatcaccatgaccacggcggtggcgatcatgcccacaatcagtgtgattttaatcatcgagaaccagaactcggcctcgccgaacacgcgcaccgcaatcaggttgatggccaccatggccagcaggaaggccagctcaatcaggaagcgccaggaggacaggtcgatgccgaacgtgttgaagaacgtgacgaaataggtgcctacggcggtcagctcggacatgcctatgagaatcagcacgatccagtaggaccagccagcgaaggagccccagcccgggcccaggtagcgcgaaatgaacgcgatgaaagtgtgctggtcggggtcggcgtacatcagctcgccaatcgcccgcatcagcaggaacatgatgaggcctactgctatataaacgaaaatgatcgatggaccggtcagagcgattgacttgcccgagccaaggaagaggccggtgccaattgtgccgccgatggcgatgaactgcacgtgacgcttgctcaagccacgctccatctggttgcctgcaccaggccgctgaccggcgccatccgtggattcggccgcagcctgccaggaggccgaggtctgctgattgtcttcgtctgaatttcgcataggacacctatcgtaactccccatctgggacgagcggtaggggcatccatccagcgagacggagagcgcgggccggcgcgggcctggctagactggcggatggactttcctaagccagggcccacaaggtttggcgggcggacagcgtcaagcgggcgacgggacggcgaacaacgcctcgcgcggccggtgtaagcgagcagtgaccatgaaccgaaagcaggaagcgcgagcgcgatgaacaagcaggatgccccgaatcatcagaacactgcggggccgataacagcacaggcagcgacaggggcggaaggaaagagggccagcggtgctctgcaacgcaccctcaaaaaccgccatatccagctgatttcgctcggaggggccatcggcactggcctcttttacgggtccagcgagtcgatcaaactggccgggccggcgattctgctggcgtatctgattggtggggcggccattttcatgattgtgcgggccctgagcgaaatgagcgtggaagacgcccaagccggcgctttctcctactacgcgagtcgctactggtccaagcgcgcgggcttcgtctccggctggaactactggctcaactacattctggtttccatggtggagctggccgtggtgggttccttcgtcagctactggttccccgcgattccagcctgggtttcggccgccgtcttcctgctggtgatcaccgcggccaatctgatgggggtggcccgcttcggcgaattcgaattctggttcgcgaccatcaagatagtagcgattatcgcgatgatcataggcggcgctgcggtagtcatcatggccctgcctaccacgggcggtatgcgcgcttccttctccaactggttcaacgacggcgggttcttccccaccgggctgctgcgacgcgggcccggcgggcagtggaccgggctgctcatggccctgaccatggtcatgttcagcttcggaggcactgagctgattggcatcaccgccggggagaccgctgatccgcgcaagaccataccgcgcgccaccaacgacatcatctggcgaatcctggtcttctatatcgccgccctgggcgtcatcatggccgtcgtgccctggcgctcgatcggtcagccggatgcgcggggagtggtgactagcccgttcgtgcagattttcgattcggtcggcgtgcacgcggccgcaggcatcctcaatttcgtctgcctgactgcagtgatgagcgtgtacaactccgccctctactccaactcccgtatgctctactccttggcccagcaaggcaatgcgcccagctacctggcccgggtctcgcgcgggggcgtgccctacgcgggagtgctcacctcggccgcgatcaccgctctagcggttctcgtagtcttcctctggccgcgattcgccttcaactatctgatgagcgtggccacgatcgccaccttaatcaactggaccatcatcatgatcaccgaaatgaagttccgcaaggccgtggccgctggacgcgggcctggggcgctggccggcagaaccggccaaccggccctgaacgctatcgccttcaaactcccctggccgcgcgtgaccccctgggtcctcctggctttcatggccctggtcgtagcgctgatgtgcttctctccgtcctaccgcgtcgccgtcatcatcggccccatctggctggccgccctggtggccgcctaccagctcaccatgcggaggaagcgctaggcggtctttcgttccaccacccatatcctgctatgtgaaaaccgctcgtacgtcggcttgtagccagggcggcaggcgttaacagccacattgaggtatccggcggccgcaccttctaatccccggtcgcacggaccgtggattgggggggggagcgactgggaaccaacctcatagggaaagacaagcgcccctaggaatccctgcctgctcggattggtttcaaagacgctgtcctgccccgaatcccgcgacggaagaggccagcccaggattttcgggggttttaaggatcggaacgggtgaaaacgggagtgggaaagcccttcgcccgcttattggcggaaggacgtaacacactagcggcaaggatgcggtatagtgtagggcacattacaagtcacagaagaggtcgctgagctcatcagtagccaggtggaggcgttgcggcgccggtgaaacctggcgaaagggtggtcagccgaaacgtccaggagccgctgagcctgggggttgggactgggttcaacaaatccaggactgtcgcagcggatgcgctgcggagcgctatggacggttcatgcgttagcctcagtcgacggttgcccggaggcttcgcgcccccagcactacggctgcggttttcgtcgttttcacgctccttcttacgtattgcaaggaggatgactcatggcccaacaggaagcatcgggcaattcaagcggaactgccggctcgtcgggggtgcagcgcaatttgaaggcgcgccatgtctcgatgatcgccctgggcgggtgcatcggcaccggcctgttcatgacatccgggtccaccatcgccaaagcaggccccggcggcggtctggtggcctacgcggccatgggcatcatggtctacgccctgatgaccagcctgggcgagctggccacccacctgccggtctccggctccttcgccacctacaacgcccgctacgtggacccggccctaggcttcgccatgggctggaactactggtttaactgggcgattacggtggcggtggacatctcgaccgcagccctcctgatccaatactggctgcccaatacgccaggttggatttggagcctgctggtcctggtcatagtcttcaccatcaacgcgctgacggtctcggccttcggggagaccgagttctggctctcgctcatcaaggtcctgaccgtcatcgtcttcctggtcgtcggcttcgctatgatcttcggcatcatgttccaccccgccgtgggcctgcggaacttcacctacaagggcgggcccttcgtgggcggcttcccggccatcctctccgtcttcctcatcgcgggcttctccttccaaggcaccgagctagtgggcgtgacggccggcgagtcggacaacccgagcaaggccgtgcccaaggccatcaacgaggtgttctggaggatcctcctcttctacatcctctccatcttcgtcatcgccgccctgatcccctacacctcccccaacctgctgagcgcggccgacggcgatatcgccatgtcgcccttcactctcgtcttccagcgggcgggcctggccagcgcggcttcagtcatgaacgcgatcgtgctcacctcggtgctctccgcagccaactcaggctcctacgcctccacccgcatgctctacgccctggccagggaccactacgcgccccaaatattcgcgcgcaccaccaagcgcggcatcccgatggcctcgctgatcgccactacaatcgtggccctggccaccttcgccacctcgatcttcggccagcaggtctacatgtggctggtggccgcctcgggcctgaccgggttcatcgcctggctcggcatcgccatcagccacttccgcttccgccgggccttcgtgctccaggggcacaaggtctccgagctcaagtatcacgccaagctcttccccctgggccctatcttggccctggtcctgtgcctggtcgtgatcgccgggcagaacatcgaagccttcatccagtggaattggcaggaaatcggcgtgacatacatatcggtcccgctcgtgctcatcctcttcttcggatataagattaagcaccataccaagctgattcccttgaaagacatcgacgtatcagcggcacagacaggtgtggaagagcatgaagcagcagagcaggtccagggctaaagcaagcgacgacccccagggcggggcgggcgcagggggcggcaacgccgtgcaacgctccctgcgcacccgccacatctcgatgatcgccttgggcgggtgcatcggcaccggcctgttcatgacatccgggtccaccatcgccaaagcaggccccggcggcggtctggtggcctacgcggccatgggcatcatggtctacttcctgatgaccagcctgggcgagctggccacgtacatgccggtttccggctccttcgcctcgtactccgcccggttcgtggacccggccctaggcttcgccatgggctgggattactggctgaattggaccatctccggggcggtggacatctcgaccgcagccctcctgatccaatactggctgcctaacacaccgggttggatttggagcctactggtcctggtcatagtcttcctgatcaacgcgctcgcggtctcggccttcggggagaccgagttctggctctcgctcatcaaggtggcaacgatcatcgtcttcctggtgatcggcttcgccatgatcttcggcatcatgttccacccggccgaaggcctgcggaacttcacctataaggatgcgccgttcgtgggcgggctgccggccatcatgtcggtcttcctgatcgcgggctactccttccagggcaccgaagtggtgggcgtgaccgctggagagtccaaggacccaagcaaggccgtgcccaaggccatcaacgaggtgttctggaggatcctgctcttttacattctctccatcttcgtcatcgccgccctgatcccctacacctcccccaacctgctgggcgcttcggacgcgaatatcgccatgtcgcccttcaccctggttttccaacgggccgggctggcgggggctgcctcggtcatgaacgcggtggtcctgacctcgattctctccgcggtcaacaccggcgcctacgcctcctcgcgtatgctctacgccctggcccaggaccactacgcgcctaagatcttcgcccacaccaccaagcacggcatcccgatggccgcactgatcgcaacggtatgcatgtcgctagctaccttcaccacttcgattttcggccagtccttctacctgtggctggtgaccgcgaccgggctgaccggtttcatcgcctggattggcatagccctgagccacttgcgcttccgccgggccttcaaactccaggggcatgacgtgagcgagctcaagtaccactccaggctctaccctctgggccctctcctggcgatggcgctctgcctgatcgtcatcgccggacaggacatcccctccatggcaagtctgaactggtcacacatggccatgacctacttcagcgtggtcctggtcctggtgctctacctgggctacaagttcatcaaccacaccaagatcgtcaagctcaaggacatggacgtctccgggaccgacgtaatccccggacatcgaaatcagacaaccgatataccggtgtgactcattcagtaaccatgtggatgtaacggtaggctgtcgattcagatattgctagctgtttagcaacccgcgcaacagaacccttgatgttgaaacaacctcgatcattaagccgtttcatcacatcgaggcgtcgctctgtacccagctgatccacacgtaacccggtctcaacacagaccccatcaatcacctgggaaacgatatctccaactgaggcaaccaggttctcctcctgttgatggatattatcatagtcagcagagggaaagtacatctctttgagctgccctaccatatgctcaacggccacgagcggggtgcgatcactgttaatacacaaggcgccgactatccttccttgccgtctgagcaggcaggttgacgagactaaggggttcttgttggtggacgactttcctctgtaccccaccatgtagtcctttcctccttgtgccccgtcccgaagcaaccgcaacaggaaatcagtggctggagaccccacactccttgaagaaacatgaccgtttgcaatagcaatgattgaatttttcacgttagatgcatcgtgtagaaccacctcagtcctcggacccaacacttcacccaggaaatccaccaaaggaaagaactgtcgaaggtaggctgcatcatccgccgcctcggaatctttaccagggaaggaagcttcttgagtcataactctaacctctccatgtttggacacgaccttatcacatcgaattcggcatgaaatcagggtggaaacagctttagtttttatgctcccaccctgtattcactccaacctgaacctccggtctagagtaagctctcacccttactgatataaccggccatctcgtccttaggtaccatggatccgcctgtacaccaggcgatgtgcgtggcatgcgccatgctaacatcatccagattcattttctgacgatactcgttacctgccagaattcgccaaggacccacgaatccagcggcagccgacggctcgatatcgatgccagccttgtcgtgcaggttggcttcgatacggaagagctcatcgtcatcaattgtaaagaacccatcaacaagatgctccatggccttaccaacgaagcgcgacgggcggccacaggccaggccatcggctgcagtcacgttgtcaataccgaagtcctggacgcatatcttgtcatgcagacccgtataagtccccagaaacatggagggacagtgcgtaggttctgcaaaaatgcaatggacatcatcaccgaaaacggtcttgaggccgaaggcaacgccgccaggcgatccgcccactccacagggcaggtagacaaagaggggattgtcagcattcacgcgcacgtcgtaggtctgcaactgaccagcaagacgtctgccagcaaccgcatatcccaggaagagggttgacgaattctcatcgtcgacgaagtacgctttctgatcagcttccgcctctttgcgcccagaggccactgctaccgaataatccgattgatattcgaacacatggactccattggcacgaagtttgtccttcttccactgcctggcgtctgctgacatatggacactggcgtcgaagcccagggcagcactcatgattccgatggacaggccgaggttaccagtcgagccgactgcaattttgtattgcccgaagaatttcttcatttttggggtagcaagtttacggtagtcatcgccaggttccaaaagtcctgcttcaatggccagatcctcggcatgtttcagcacctcgtagataccacctcgagctttgatggaaccactgatgggcagttcactgtcaagcttggcccagagttgccccggaagcgagtgcccataccgttccccaagagccttgctctgatcgggaacagctaccagcggtgactcaatgatgccttctgaggttttgatcgacggaaagagatccatgatcaggggggcgaaacgcttcagtctgtcagctgcatcatcgacgtccttaatcgttaaccctacatgggcgataccttcctgagccgattgcaaccggctgttgaaccaggtggtttccttttcatgtctcaggtcatccaacacagggaagtccttgacccattcggacattgacttgccttgtatttcattgttcatggtttgactcctttgttcacaattgttgacaactgcctttactgttcagggtgaggaccttagaccaccaggctcagcaagagggtcatgcagagggccaccacggaggttatggtggtgccaactgtcagggtcttataggcctgtgggacactgatttgcagatactccttgaccatccaaaagagtgaatcagtgacatgggtaaggcctatggcacccgcaccgatggccaaggccaaaattgctggagaaagattgggattggctgaaagcatcggaagcacgattccggcggcgctaatcatggcaaccgtggcggaacctaccgcgaagtgtaggatgagagcaatcagccaagctaggattaccgggcttacaggtaggtgagcgaaagcctttgccagtcctggagccacacccgaagcagtcagtactgcgttgaatgcccctccagcacctataatcaagagaatgccaccgataggtccgaaggagccgtcggtgatctcctggagcttctcaataccaaaccctcggttcagccccaatgagaagtacgcaaagagcagtgcaattgtgagggcagagatcggattgccaataacattaatccattgcattgccaaagtatcagctggaatcagccgctcacagatggtgcgggtgaccatgatcaggaggggtagaaggatggtaagcaaggtgataccgaacccaggaagatccttctcatccttttctacgaaattacccaagcccccttcggtgatctcctgaagagacgagtcatgtgcaggtatagcaaaatgagcaaagagcacacctcccacgagtacggaggggattgccacacaaagccccaaaaggataaccataccgatatcggcatgcaaggtcccggcaatggcggtagccgcgggatgtggcggcaggatgcagtgaacaaccattagagaggtggcgaggggtattcctactttcaaccgggatattccggcctcctttgcgaccacaaagaccaaaggaaccaagagtacgaaccctacctccacaaagacagggataccacaaatcagacccaataaagccatgataatggtggcacgttgtttgccgaaagccttgagcattgagtgagccaagcgctgcgccccgccagaaacctccagcaacttgccgaggacggccccaaaaccgataatcagggtcagaaagcccaaggtatcgccaacacctttctcaaggatatcgcttattttccccaaaggaacccgcgtaacaaaagcgactaagaatgccgcaagcagtaaggcaagcgaaggatgcatctttaccttaacaatgagcagcacaatgacggctatggcgatcaggaggaccaccagaagaggaccggtacccacgtcaactcctttgtttactgaactcagtggtaatagtattttaccacagtaaataatttttgccaatataagtatgggtacgactcttcagagtacagcgcttccaccacttaaacggaaatagataatccgggtcacacaataaaaaagggccaccgtcacttggacggtggccctatagattacagacttaggaacttataggtcactgaacctgggagcgggcgatcttcccggtgaaggactgagcctcgtcggcatccttgacgtccttgttccaggagaacatgacacgcagcctggggccgacctcctcaatcttctcgtgggagtacttctcctgcaactccttggacttaggggcgccggcatcctgatcgtcgatgaactccttggcgaaggagccgtcctggatgcgcttgagctggtaacgcatgcgatccttggtggactcgtcgaccacggtggatgtgaagtcaccgtagtgggcggtgtcggagcaggaccaacgggccttgttcagaccaccctcgttcatcaggtcgaccagcatattgagctcgtgccagacctcgaagtaggcgatctcgggctggtagccggcctcagtcagcacctcgaagccagtctcgaccaggtggttgacgccacccatgagcacatcctgctcaccgaagagatcggtctcggtctcctccttgaaggtggtcttgatggcgcctacacgcagggagcccagggccttggcgtaggcggggatcctgctcgacggcaacgaccaccggcacaccacgtccggccacgtactcgcgatggacgatgtggcccgggcccttgggtgcgaccatggagacaggatgatcggcgctgggcttgacgtatccgtaatggatgttgaacccgtggacgaagccaacaattgcccggccgcacacttacccaataagatagtgcttccaaatcacccatataaatcgagtggagaaggagagccggtaaggcgaaatcgtagatccgatggacttttagcagctatttcaacctgcttcttgtaataggaatgaacctcaatcagggtttccagaccgcgcttcccagcctcctgcttgctggctcaaatcagttcgaaggtctttggagtcatgaaacagttggtgccggcttgtttggctccataaccgacagcatctagccggatgtaccgtacacgactttctgccagcctgtcgagaatcaacatgatataaccccacccctgctcagtcccggtatcaatgtcgacccgctggggggtggaaatggtccagaccaatctcgtttttcctgcccagtcgtactgggtaaagggcaaacctggacaagggcggtaaatacccgtcaaatcttcttccgaagcaccttctgaaaagacagaagacatggttaggaacatattgtggtaaaggctcacctcgccttggcgcatgacatcctggaattctctggattcccatgacatgttgttgacaatggtgtccaccatgatcccatgggtacggctcagctccctaatgtcctcccaggagcccagacgcgaatccaccttggtgtgatcggttggatcgaaaccgggatccgcgccatcgtacggggcgaaaaaggcaatatgtgaatgccacaataaacaccatcgaacctggttcgcagcatttcagccaaggaagcagagtaccgtctccgaaacggtccgcataggcgatgggctgaccctgttatccgcaatttctccttacaacgcctacaggcccactcggagcattttaccaaaccgattttacaagcatccgacaaaccaaggacactggacgacactgacgaattcgtcagtccatcagggagtgaatctgaacgatctggtcgcggccggggcccaagccgatggccgaaatgcggcagccagagatgtcctccaaagtggcgattggcgcgaaatcgcgatgacctacttcagcgttatcttagtgctcgccccgtatttgggatacaaaatcagccaccacactaagatcgtgccccctggatgacatcgacctggaaccgaaatcagtggccgtcagcgactgagcaggctttgaatcgagcccttccaacgggtggattcaccaggcttgagcgtcatcgggaccagctcggactgggcggataggccgcccggggcgcccgagccaacgcgagcggaccgcgcggcgtgcttggtcctcgaccttgcaccagccgcgcgcgggctaccgccctgaggcaaagggacctggccgtctcgcccagggatgagctgcacgaggcgccgggccaaggcggaggccacgccgtcgaagtcctggaggacgctggtcagcttgacgccagccaggtcggagacgtaagtgccgtcgtaggcgacgatttgcaagtcaccgggaatcggacgaccccggcggatggcctcttgggcgcagaaggcggccgccaggtcaggagcgacgatggcatccaagtcggggcagcgctcgaaggccagataggctgcgttgcggaactcctccatccgcgcgactgactcaatctcgatgtagtcgtagcgcacgcccgccgcccgcaggctgcgctcaaaggccaggtgatagcggacgggcgggaaggtggattgaccggcaatcgtgacggaccccaggggcaccgaatcgacgcccgcagccgtttggtagtggatgcgggggcctccgatctcgaccacgcgccgggctccggtcttgataaacagggctgccgccaactggccaccctggctgtggtcagagcccaccgagggaatcgaggagcccaagtagcggtcgaaggccacaatcggccggtcgatcgaggaccagtagtcggccggatagaccgtgtgggcgcccatgatgatgccatccatagcccgccgcctcagcatgtccacatactggctgacgtcttgatccacgtctgcggtggagcacaaggccgtgcgcagaccctgctcgtagagggctcgctgcaggctggcggtcagcgtggcgaaaaatgggtggcgtatggtcggaacgatgacgccgaccaggttggtccggttgcgtgagaggttgcgggccaactcgttgggcacgtaatcaagctggtccatggccgcctggacgcggtcggccatggcctgggagacgtaaccattgccattgacgaccagggagaccgtgctggtggagacgcccgccttcctggccacatcgcgcatacctaccatttgagagcctcccgtcgaatcaacggggtatcgaacgttcgataccctgcggcctctcagtctaccagagagcgcagggagacgatctgcccacgaccagcgccggaaccaatggcggaaatcctgcaaccggagaggtcctccagccgatggacataatccttggccttggctgggaactcgtcgaaggagcgagcgccctggatgtcctcggaccagccggggaactcctggtagacgggcttggcggaggtgaactcagcctgatcggtgggcatgtgatccacccgggcggtcgagccgtcggccatcgtcacgtcgtaggccacgcaaaccgggatggactccagaccggtcagcacgtcgagcttggtgagcacgatgtcggtcaaaccattcacctgggtggcgtagcgggaaaccagcgcgtcgaaccagccgcagcggcggggccggccggtggtgacgccgaactcatggccgtgcttgcgtagccattcgccggattcattttccagctccgtggggaaggggccttggcccacacgcgtcacgtaagccttggccacgccgatgacccggtcgatcttggcggggcccacgccggtgccggtgcaggcgccgccggacgtgcagttggaggaggtgacgaaggggtaagtgccgtggtccacgtcgagcatggtggcctggccgccctcgaagaggacggacttgcccgcatccaaggcctcgttcaacagcagggaagtgttggccacgtaaggcttgagccgttcagcggccttcaggagctcatcgacggtctggtcgatgtctaccggcggcaaatcatagatcttctccagcatcaggttcttctggtgaagggaggcttccaccttgtttcgcaagtgggcggcattaaagaggtcatggacccggatacctacacggttgaccttgtccacgtacgcgggaccgatgccccgaccggtggtgccgattttgtgggagcccaggaaacgctccgacaccttgtcgagccgacggtggaagggggcgatgatgtgcgccgcctcggaaatcttaagcttggagcagtccacgccgcgcgcctggaggccgtcgatctcggacaggagggcttcggggtcgatgaccacgccgttgccgatcaccggggtcagccgggggtggatgatgcctgagggcaggaggtggagggcgtaggtctggtcacccacgaccacggtgtgcccggcgttgttgcccccgttgaagcgggccacgtaatccatcctgctaccaatcaagtcggtggctttgcctttgccttcatccccccattgggctccgacaatcacgattcccggcatgaaatcctcctccacgtcagacgatcttccgcgcctcgcgccgaatcgaccgccagcagcagcctactccggagcgtggagcaaggagccccgccgccaggctcggacgcccggcttggtttacttcagggcccgacccgctgagcctagctgctggcaagcctggaccacgcgggcggccatcgagtcctcagcccgccgaccccaagcgcgcgggtcgtactcgctcttggcgcccacctcgccgtccactttgaggaccttgtcgtagttggtgaacacatggtcggccacaccgcgagtgaaagcgtactgggtgtcggtatccacattcatcttgacgatcccgtgggtcaccgcttgggcgatttcctcgggacgcgaacctgacccgccgtggaagaccagcaggaagggcttgctgtccggggcctcggccgccgcgcgcgccgtccgctccggcagaccgccctgagcggccgcctcagccgttgcgctttggatgcggcccaggagctccgggcgcagcttgaccacgccgggcttgtacgcgccgtggacgttgccgaaggtgaaggccgccatgtagcgcccctcctcccctaagcccaaggcctgagccaccttgatgccgtcggagggactggagtagagccgctcgtccatctcggccgactgcccatcctcctcgccgccgaccgccccgacctcgatctccaggatggtatgggccgcctgggattcgctcaggagctcgcgggctatgcgcaggttctcctctagcggcagggtggagccatcccacatgtgcgaaaggaagaggggctcctcgccgcgcgccacctgctcacgctcgtaggccagaagggggcggacccacccgtccaggtactggggggcgcaatggtcggtgtggagggcgagcgtgacgcccttatacccggagatgacctcggaggcgaaacgggcgaaagcgatggaaccgaccactcgatcgtggagccgctggccggacaggtagtccgcgccgcctacagaaatctggatgatcccgtcggattcagcttgcgcgaagccttggatggccgcgttcaaggtctgggtggaggtcacattgatggccgggtaagcgtaaccgccgcgcctggccgagtccagcatgagcgcgtaccgctcgggtgtcgctaaagtcatgctttcattatcgccactgccaccgataatgtggggtccgggccacgcggcgcccacttcggcggaaggggacgccggaggcaggggcgcaagccttcgcaatggtgcggaatatagaaagcccggcggatgggggccgccgggccaagaaagaagagaaaaggaacttctaccaccagtgaccgccagaccaaaccacctcggtaatcaccccgtcagctatattccgccaacaattcttagttaagcatcactttctcggcaaacttttagagttttctgggaattcaatgtgagctatgtgaatattttgtaacggtttttctttttcgttcacacacccactcgccacaatcccgcttcccaggcagaggaaagagagacccggcgggagaagagagaccgccgggcagagaagagagagattcaacttaacgagacttccacaactcggccggcatagcgcacctcgtgccgacagggacagtacaacacctttatcttggaaagaggcaggattcccctgggaatactctgagaaacaaccagcggcagggcgggaggccaggctcttggggccaggcagtagactggagccagaacgcctggtgacagccgataataaggagaatgcgatgctgctcagcgaccatgacatagaggcggcccgcgaggcagggcacatgtccctggacccgtggacgcccgaaatggtgcagcctgccagcgtggacgtgcgcctggataagttcttccgcctgttcaacaaccacgagtacacctacgtggaccctgccgaggaccaaggcgacctaaccgagcaattcgaggtgccgaacggggagccctggatcctccaccccggcgagttcgtgctcggctccacctgggagtacgtcaagctggacgggacaatcgccgcccggcttgagggcaagagctccctggggcggctgggcatcctgacccactcgaccgccggcttcatcgaccccggcttcgaaggccacatcaccctggagctctcgaacgtcagcaccctgccggtcaagctatggcccggcatgaaaatcggccagatgtgcttcttccagatgagctccccggcggctcacccttacgggtccaagggcaccggctcccactaccagggccagcgcggccccaccccctcgcgctcctacatcaacttctaccgtgcggacgtctccgactgaccggaccgcggcaattatcgaaacgacgaaacacagctagttgacggtgaagccttgctggcgcccgtaatcggataagtcttggccccattgaattaaggcttggttcaatgtgcacttgcccagatacgccttgcctactgaattagcggcaatttgggatccgtagaccatgtagggcaggtgggtccagccagaactgatttgggccgcagcgtcagagatgatctgcccggtgcgctgacctccgaagtatgggtcagtcttgtctcggaattccgcgccgttcaacactgtggcgagcggcggaataccatcctgattcaagttaacctggacaccaccctcgtgcgcaaaccaccgggcgaaatcgtatgcagcgtcgaccttgcgccggtcagcagcggcagggagaaccaaagctcctccgccgttctccgcattggcgataggctgggcttcatattggggaatcggcgctatccgccagtgaccctcccctgctttgacgttcttcttaagagacgtggccagccaagctccggtaagtaccgtggcgatccgaccatcgtccagagccttgtaccatgactcgtcccacatcttgattttagtgtccaccagcctctggtctaacaacggttgccacataccagtgaaccgccgggccccctggtcggagaagcctatgcttagatgagtcccatcgactttaaatggacgggagcccgcctgccacagcatagaggttaggaaattggcgtcaccggagtctgaagtaatatgaacacccgcgtccaagtcagccagctttcgcgctgcttgagcgtacgcctgccaggtagctggaggctgattcacgcccgcacgagtcagcaggtcactgttatagaacatgaccatggggcccgcggaaatcggcagaccgtaatgcttgccctggtagctgacattagccaaggaagaaagagtgaaatcgtcggaaatcgaatcgaatccatgctcatctaccgaatgcagctgacttgataccgcgtactgttggaccgcgttgtaatccatgtaaaccaagtcgggcacgcctttaccagcagcgatggcattggtcaactgcatatattccttctcattagaacccacgttgaccgctttgacacgcactccgggatgagtctttgaatacgcccgagtgaaatcgtcaatcgtggactgccaggtccacagcgtaatctcaaccgcaccgtccgctgggccggacgagccacatcccgccgctgcaagcgcgaacactatgaccagcaccgcagccattgcttttgctatcccgccgaatcgggaccgacaccatcgatacatgcatcctcctgacatcactgcgtgccgcgcccaacactgcggcgtgctccagcaagtacacatactaccgatgtcaaacgcgccccgtcgaagcgaagtgcgcgcctctgcgcaagcgtggaatcccgcccattcagtccgttgcaaatggcaaaaaatggcaaaaaaacccagaggtagcctactgagaggcaacccggcagaccgatcagggatatacgcaggaaagcgagatgcgatggaactcaatctcaatggcagctggaatttctacccagatggcagcgatgaagggcacaaaattaccgtgcccacctggtgggatagccttccgcagaccaccggctacccagccgagtggagtcaaggggtgcggcacgggctttatcggaggagtttccaactaagcaaagaagaccttgccgaggatttgttcgtgcatgtgggcgcgctggccacgttaggcaaagtgagggtcaatggggtgtccgttgggcccgagtctactaaggagtacctgatgacccttctgccctacgatttggacatcaacggggcggcgaggaccgggagcaacgaactggaaatcgaagtttggagcgtcaagcaactaccggaggacgcgctggcaccggaagaaggacctgaccgcctgctcttccccttcggcaccgaaaacatcgtgggccgcgtagggttgggcggcgatgttcgggtggcgagccgacctaagctgcgcatcgacgacatgcagataatccctgacctgaaacgtaatgccgacccatccgacgacgagttaacactcaaagccacgctcgtcaaccacacgcggcgcatggccaagctagccctcaaagcccaggtccgcccctggacgcgaaacgagagagcaactgaatcagcggaactgacattggagagcggacagatagagctggcggcgggagccagccaggtgattagcttgaccgctgcttggcctgatgcgcgctactggtcgcggaccgaccccttcctctaccaaatggatgcggagttgatccgaaccaccagtgggataccagtgaacaccgccagcgaccgcttcggttttcgtcaattctggagggaaggcgatcgctacatgatgaatggcttgccaatccgtctacgcggcgactccctctgcttactcaaccagggcaaccgcgacctaatcaacgaaatcggtgacgcttacggggtgattctggacgacaaccacgcctcggatgcgatggcagaagcatggatagacgcctaccggcacgccaacgccaatatcctacgcaaccacatccgttccatcccctctgacagcctggagaaccatgccgatgaaacaggcatgttgatcgaggaggagaccgctttctggaatccgggttcggtctcaaatgtgtcgttggaacccccttactatatcaactacagcgacgagaccataggctactactgcgagtgggtgcaacgctgggtgcgcgcttaccgcaaccacccatccatcatcctatggtccactaccaatgaggcatggaaccccaacgacgccaccgagctgataggtccgctgcaggaggcagcactaagggaagacccttcccggctggtgatcaatgacggtttcaataagccaatcaccaatgaggactcccgccattacttcgggggatacccctctggcatgacttccgcgcctgacatctactccctatatcagatcgactccgacctgccgctggccgccggcgaggagttctccgtatccacagctggcatcccccgatacagcgaggacggatccatccaagacatctaccacggcaggcttaatggcgaccccgacacaatcacccgcgcggacttcggacgggaggtcggccgcgtaactcgaggtgtacgcactacgcgtatggccgattggaaaccattctgcctgtccatgttcatctatgacaatatcgagcgcttcgtaccgctggaccagaagatgacaaaacatggactcaaccctaaactgctgatgcgcccgcagtttgacccgacaaagagcggcgacgaacgatggattgagggcggcgggtaccggtatttcgccaattcttacgcggatgtggcggcctatgacaaggcatacgacaaggagccccgtctaggccagccccatcggatttaccgaccaggcgagaccagcgaacgcatcattatcgtgcacaatgacgaagagcgccgcggcaccaagctggaactgcagtggagagtgtcctaccaaaccgtatctgacggtaacttgtacacaactgaggaagacacacgaatcgtagaagtgcctcacgctgagcaccgagaaagcacgatcaatatccaagtgcccgacgcggatgccgcccgaggcgccaagcttatcctcactctggcggtacgcaaagagaatcaggaagtatatcgggaggaaaacttcttaggctggatagaccgacctgcgccagccaagctagctgtacacggctcagagcgccacctaggagagttgggctgggaatcgcgcacagtcaagcacgtgattcacttagctcaagagggtggcacaatgagcgagcactggactgccacagtcgacgacgatgcctcgggagccttccagctggaagcgcggaccggcaatctgcgtcacgagcaggacattttctacacgctcaacaccgcggcgctggaagcgggcagcaagcatcgcgcagccgtgacctttacaggcgagaacggtgaaacagctcggttcaccgtcgctttcaccgtaaacgatgctccagggagcgaagatcccacgaacctcgccgctggcgcacgggtgagggtctcctcgacatccggaaagccgggctggaccgccgcagccttggtggatggcgtgttcaacgccggttatgaccgattcggatggtccagcgaaatcagcggcgaaaacaaaccacaatgggcccaattggagttccacaggccagttagcctagcccaagtggtactcgtaccacgcggggagaaccccggaggcaccgtagccgaggcctttcacggcgaaggtgagggagtgggcggcgtgctggagttcgcggccggtcacaaagcgttggaccccaaccgcgggcagggcttccctctggacttcacaatctcggtctcggaaaacggtcacgattggcaggaggtatcccgtcacgtgaattacccgttaccagataatggtaaacccagatcctttgattttgagccggtacaaggcgtacgcttcgtgcgcattgccgccagccgactgcgtcctaacccgaatgctggtggggcctacgccatgcagctgacccagattgcggcctacgccgaccaccgaatacccactattcccactgcgcccacccaggtacgcgcacaaagccgaggtcaccaactggacttgagttggagttataactccgatggtcgctcgccattgactggctccacgcttaagcttgtgaacgaacaagaccaactcatccggatggagttggatggcgcccagcagcaaacaagtctgaggaacgtgccgtatgggtcgtggatcgtcctgattcaaggtcgaaatacgataggagccggcgaactttccgaaccctatgaaacccttgttggagagacgcagtccgaacaaatcaacagcactctgcctcgaccggaccagccgagcgcagaagtggatgtggatcgagcgcaggtgaacctgacttggaaggctaacaatcttcctaacgatatcgagggatggaatctgatactctcgccaatctctggtgacggccaggccctgaccgcatgggccccagccaatgaggatgagcccagctggacctttgaacaggtgccgacagggagctaccgagcctggttggaggcgaccagcacggttggcgcggtttccgaaccctcccagccgagcgccccaatcatcgtggcgcacactcctgccaaacccaacaagcccggagtcacctcatccgggcgccggatgaaggtgacctggcaggtgcccaccgacggcggtaccccagtcacctcctacgtactcaccctgcgcaacttgaccgaaggcaaaagccaggtggtcaaggccgatgccagccagacggtggtcagcgtggatgccctggcaccggggaactatacagtctcgatcattgctgtcaacgcaattggcatgtcccaagagtccagcccctctctgccttgcatcatcaagtgagcccaaggcagcaatcggcaatgaatgtccagcaataaccaataagaaacagaaggagaaaagctcaaatgagccaatcgcaagtcgcgcctcagcctcaaaagctaacgccactcaacatcatcggttacgggacaggcgatgccgccaacaacgtgggctggcagatgatgaaccttttcctgaccacctactacgtctatatgggcatcgacccgatggtggtagcgaacatctttctgggagcgcggctcttccaagctgtggtctacctgttcgcaggcaatgtcactgacaacttcaaacccaacaaaaacggcaagttccgtaggttggtagtcatcttcggtatcccactgatgatttctgtggcgctgatgtacacgattccgccgaactcagccatgaacatcaaaatcatctgggcgattgtgacctacctgctctaccagctcttcggcgccttgggaggcgtgccctacggcgccctgctgggcgcgatgaccgaggacccgaacgagcggcagaagctgtccgcagcccgcaacttcggttccgcagccgtcgggatcattttcaccttcaccctggccacccgtgtcaactcgatggacccctccaagctcttcctgcctgtggtctccgtcttctgcgtgctgggtgccctaggctacgtgttcatggccaaggccacaatcgaacagtacacgcccgctccacagaagaaaacctcaccactgcatagcctacaggtcatgttcagcaacaaggctctgctcctggtctgcttggccacactcttcatgaccaacccggtgggctccatcgccccaatcgtggccaaagaagtcctcgccgtaggccagccccacctaatcagccaagtcacgttcgccttgaccctggtatccgtgctggcaggcgcagtcatgtccccattctcccctgtcatcgtgcggcacctaggcaagaagaccacttggatcaccggtgccgccatcgtgatcatctcctccttggctttcatcttcgtggagaacgcctggttggcagtcttcttcatcgccatgaacagcgtcggcgtgcagtttatcaccccttgcgtctgggccatgcaagccgactcggtgcagtaccacgagtggaaaaccggtgagaaaaacaccgagggcgcagcaatgggcgctttgtccttcacccgccaggtaggtggcgccatcaacagctgggcaggtcctgccatcctctccttcatcggttacaagtccggcatgaacgtggcgcaagatccttcgatccagaccaatatgcgtttggccgtcggcctagtaccgacaatcgtgttcgccatctccgccatcctgattttcttctatccagtcactgaaaagaagttccggcagataactactgacttgaaagagcgccatgccaaggaggcggcacaagcctgatacactacggacgcgaaccgcttcaatgtgacggacgaccaccgaagcgtattacggagcgacgcgacctgcccggaattgagatttcggataggccacgccgctcctgcgcatccagcgtgcgacctacactggtgcaataaccattggcagcattcaacatcgaggttttatgactgacggaagcgggcatcaggccgctggcggcacagctaaagccaccgtccgcgtgcgtttggctgacgtggcagcagaagcgggcgttgccatatccacggtctcccgtgtcttttccaagccaacacgggtcaacttccaaaccgcagaacgagtgcgacaggtggcggaccgtctgggttacaggcccagaccagaccgcacggcaacagccgggaatccctccgataccgaaaatgaccggggaagaggcatcatcgccttcctgacccaagacacagcagacggcatttcctcacaaatcctcaaaggcgcgcaaagagaggccatcgcctcaggctgtgcggtatcggtcatcgaaacagggccgtccgctccccgttcggagagcctgctgaggctcctgatggaccgcacggatggcatcatcatcgcgaacaacgaattgacagccgagtccatacaccggacagcccgtcgcctgcccacggttgtggtcaacagaccagtcgaaggtgtgccatcaatcgtgcctgacccgacgatgggcgtcacccgcgccctacttgcgctcaaacgctttcaccaccgttcaatcgtctacgtgagcggcatagatggcttatgggccgaccactcccgatgggcctgtctggagaccataggccggagcctaggcttcaagactcaccgaatcgggcctgtaaaagccaatgtggaaggcggcgtgcaggcggctgcggcggtggaggaccgcctgcccgatgccatcatcgcgtataatgacttaatcgcggccggactggcactgcgtctacaggccgatgggctacgcatacccggcgatttgtcggtcatcgggtttgataacacgctcattgcccctgtcgtaagtccgtctatcaccacaatccgcataccgcgggcacaaatcggccaagcggcggtcgatacgttgttagggcgacaggtcagacatgcgccctcgtcgcgcgataaccaactgaaaatgtggttgactgcgcacggtctatctccccaggaggcttcccctgagctcataccagtggacacctcgctaatcatgcggcgaagtaccggggaaagaggggctcaaaggcatttgatttcaagcctacttgaagttgtataagtggggctatacagccttatggccgtcgtctttttctcgccgcttcgcgcgagggcggccgaggcggtcacggaggcgagctatgagcaatatcttgattctgggcgcgtacgggcaaatagcccggatcgtgcgagggcgcatgttgactgagagcgacgccctcctgagcgagtacctgcgtcggtctgagcggctcaagcccatcgacccctcgcgtgagtccatcatcgaaggcgacgtcaacgactacggcaacctgctgtccgccatgcgcggccaggacatcgtctacgccaacttgggcggggaattcgaacccatggccaagaacgtggtgcgggccatggacgccgttggcgtgaagcgcctgatttgggtgactggcctggggctctaccatgaggtgcccggcaggttcgggcagtgggtggaggacagcatcggcagcgaggttatggacgacacccgacgggcagcccaggtcatcgaggagtccgacgtggacagcacaatcatccgcgccgcctacatggacgatgagcctgacctggattacgagctgacacgcaagggggagccgtttaaaggtacgaccgtctccagggccgccatcgccgacttaatcgtggatatcctcaagaacccgagcgagtacagcggggagagcctgggcatagcccgacccggtaccgagggggaccacctgatctggaagtcccagggctgaaggaaccgccggcatgccgcaccggcggcacgcccccaagagcggcaccgcgcggcatctcccatcgcccgctgcggctttccgcaacagcaataccagtaacagcagcaatgtcagcagagtatgaattataaggagccgatcatggcaatcaaacagaccgctgggcacgaccgactgggcgacttcgccccagagttcgcccacctgaacgatgatgtgctcttcggggaggtgtggtcgcgcgagcgcgagatgagcgctcatgaccgctccctcatcacgtgcgccggactcatgtcgatggggctcttcccccagctcaagagccatatggaactcgccaagcgcaacggcgtgaccaagaccgagatggtggagctgatcacgcatttagccttctacgcgggctggcccaaggcctggtccgctttcggcctggctaaggagactttcggggccgacgagtccgacgcggcggcggcgcccacagccgagcccatcgccaaccatggcccctacccgctgggcgacccggcggacggccccaacttcaccgggcacgcctgggtgcagtacctgaccgaccccggcgctgagtgcagcgcaggcaacgtgaccttcgagccgggctgcgtcaaccgctggcacacccacccgcacgggcagctgctgatggtgaccgccggccgtggctgggagcaggaagagggccaggagccccgcgagctcaagcccggcgacgtggtcttctgcccggcgggcgtccgtcactggcacggtgccgctcaggactcttcgatgacccacgtggccgtgacccccgccgcccccggcgagcaggtagtcgattggcaggaattccccggccccgccgcagtcgcccaactgggctgaccaaagcgcggcagtaacccgcaaccgccctggaccgcgacgagcggagcccatggcggttgcgggttgcccgtaagataaggcttatggcacagaagaaaggcccgaccaaaggttcgggcggtaagcatcgggggaagttgcgcggcaggggccccaccccaaaggccgaggaccgcgtgtatcacaaagcgtacaaggccaagcaatcagcgatcaagcggcaggcggctgacccaaggctggcggcccggcggcgggcggaccgcttcgccaccgaccccagcgacctggtgatcgggcgcaacgccgtcttggaggccctgcgagtcggcgtgccctccagtcagctctacgtcgccgctcggcttgagcacgacgaccgtacccgggagatcatccgcttggccgggcaggagggactgaacctgttggaggcggaccgcctggagatgaaccgaatcgcgcactccagcaaccatcagggcgtcgcgctgaaaacccagccttaccagtacgctaccctggccaacctggttgagcaggccgagcggcactcagccgccatgagggccgtacagggagccgcagccttggccgcccgcccgctcttcatcgctttggatggggtgaccgacccgcagaacctgggcgcggcgattcgttccgctgccgcttttggcgcttcgggcgtcatcctgcccgaacggcggtcggcctcggtcaccgctgcggcttggaaagtctcagccggcgccgccgcccatctgccggtagcccgggtcgtgaacctgaccagggcgattgaagccctgcgcgagcgcggatactacgcggtcggcctggacggcggcggcaaggccctggtcggcgagaccggtttcgagaccgaccccctgattgtggtcctcggatccgagggcaagggtttgagccggctggtgagggaagcatgcgatgtgatcgccagcatcccaatctcctccaccgtggagtcactgaacgcctcggtggctgcgggcatcgccctctattcggtcgccaacgcccgtcgcctggcagggctggctcaggagaagcagtgatccggcgctgacgaaccgcccgccgccgcaaaaggaaagcccgacgttgggtactctcagtcgtcgggctttcccgcgctttacgcaggctcggacgcagcgtcagctggcccagaccgaggcgtcctgatcatcgcggtagtcgtcgtcaacgtcatccgaatcggcggaatcgtcgcgctcgtcggccgcctcgccctgcgtgccatcctgcgcccaccgtcggtcatcgtccacgaccgccgagtcggcctcgtcgttgatcgtcttcatatccgcggcatccagcttgtactcgggcagggactcgtcgatgtagtcgcgtacagcctcagccagggggacgtcgtgaccggcctgctcagccagcagccaccgtttggtcaggacctcgtggaagaactgggccggctcgatccgcgatcggtactcggggggaatcatgcgcacggtcggctcgaacacctcccgcatccaatcagtggcgacaatctccaactcctcgccctgccgccaggtggaggtacggtagacatccaaatcgttgagcaagcgccgggcctggttctcctgcacgtccaagccggtgagcctgagcagcttgcgtgaggcgtagccggcgtcgaccacgcggggacgcaccagcacccgcttgccatcctcgtcggtcttcatctccagctcgtccacgtcgaaacccaggtcattgagcttgttgaccctctgctcaatcttccacatctcgtccgggctgaaggactccgcctcggtcagggcggcccatagggagcgataccgaccggccaagcggttgccgacggccacctcgtccacatcgggcgagagcaggtcgccggagttcaggtccatcagctcgccgatgatgttcgtgcgagccaggtcgatgtcgtattcgcgctggccgtcggtcagtgacgggtaaagggcgccagtctccgcatccaccaggaaggcggcgaaggagtcggcgtcgcgcaggaaaagcacgttcgacagggatacgtcgccccagtagaacccgcccaagtgaaggcgtaccagcagcacagccagggcgtcaatcaggcgttcggcggtgtcggggcgcaggttgcgcgcgaaaagggccctgtaaggcagggagaacttcaggtgacgggtcaccaggatggcttccaaaggctggccggaggcatccctgcgaccggtaacaaccgcgatcggcgtgaccgccggcaggtcgagcttgaccagtttgcgcaggagctcatactcgcgctcggccatgcgctgggtgatctccttcatggcgtaaacctcatcgcccacacggacgaagcggaccacgtgccgggagatgccgcgcggaaggttggccaggagctccttgggccaggtggccagcggcttctcccagggcaaagtgaacatcttggggttggatgaggccgcggtaatcctcagcgcctcgggctcccgatccgcgccggacccgctcggcacctgcaccgacgtggccttgagggccctggggtccaggctcaactgatctgtcgaatccatgcctccaacctaccttcgggaccagagaaagagcggacgcgaatcgccgcctccacgccgccagcgagcgcggccagggaaaaccagtggccccgccctggatgggggtggggccactggaggagcgcgcagagaagaagaggaaaaaagacgcgctcagggggcagcgccaggatggacccggcgcgcctggattcattattagttcagacgcagctccgtagacggggagaacaggtgcatcttagccgggtcgatgtgaatcttgaccacatcgcccaccttgggcagctggcgggggttgacccggatggtggtcagcttgttctggtcggacatgaccgtcgccttctcggcggggctgtcgtcggtcagaatgttgccatagatgtagccatccgagcccaagtcctcgacattcgccaccgacagggagaaggcgtcaggctcgccagcgccggccagggttgcgtcctcggggcggaagccgaccacgatgcggccattgtcctcggccgtgagcttgtcgacggcctcgcgcggcagactgaccgtatcctcgccgatcttggcatggccatccactaccggatggatgttgatgttcatcgacggggagccgatgaagccagccacgaacacattgtcggggtgatcgtagagctcggtcggagcgcccacctgctggaggacgcccagcttgatgacggcgatcctgtcgcccatcgtcagggcctcggtctgatcgtgggtcacgtacaaggtggtgacgccgagttggcgctggagggccgcgatctgcgtacgggtctgcacgcgcagcttggcgtccaagttcgacaggggctcgtccatcaggaagaccttgggctggcgcacgatggcgcggcccattgccacgcgctggcgctgaccacccgagagggccttaggcttgcggtcaaggaactcggtcaaatcaagaatctcggccgccttctccacccgctggcgaatctcatccttgggggtgccggcgatcttcaaggcgaagcccatattgtccgccaccgtcatatgggggtagagggcgtagttctgaaagaccatcgcgatgtcgcgatccttgggctgcatggtggtgacatccttgccaccgatcatgatccggcccttgttgacctcctccaggccggccaacatgcgcaaagtcgtcgacttgccgcagccggaggggcccaccaggaccaggaactcgccgtctttgatgtccaaactgaggtcatccaccgagggctcgtcattgcccgggtagatgcgagtcacatgctcgaataccacttctgccattgttcatcctttcatcggcaggtacgtgccgaacgatccgtagtgaaggggttccactgtggtaccgcctcgagcccagccatcaacggaggggccgcggaacggtcttgacttatcgcttaagagaaactctcccttgagccaaaatccagtatatacctcaaagctcccgattccacccaagccccacctcacacactgccggcgcctggttccctctccttggtcggcgcgacgccaagcaggaaaacccagcggccttcgcgcgcacgcgcccaggcagcggcgaggcaaagccgcacctgcctgggccacgcgcttactcaacctcgaaaccttgccccttggcgtaggttttcaggtcattctgccaggctgcgatgccatcggacagcttgatctcgcctccgaaggccttgcccacgaagtccccgtactttccgcgagcgtagacctcgaagggcaggaactggtaattggtggacacctgggaagccccctgggcgaggacctcgttgaacttctggccaccgaaatactgcacatcctggccttgggcattcttgaccgttgtggtatccaggaactccttggacttgagcgtcttagggtcagctgggaaggcgccgccctcgacgcgggtcttgatgccctcggagtcgtggttggcgaactcgatgaacttccaggctgcgtcagccttcttggtcggggccatgatcgccagcgaagaaccgcccagctccgagttcgtgggcttgccgtcaggggtaggcatgggggccacacgccacttgccggcagctccagcagcggaattagcgaaattggctggcatccaggcgccggtcaacaggccggcgatcgaaccgtcggagaaacccttgaaccattcctctgtccagggggcggtcttggtatccatgagcccctcggagatcatcttctgccagaacctagtaaactccttggtcttggcatcaccggtcaagttaatcgtcacccgggacccatcgttcgaagtcttgaagggttgcccccctgccaaccaggacatggcatcgtaaacaccggcatcgccgtagtcaaccataatcacggaaccggtggccttcactttcttggccgcctcgtaatactcgtcccaggtctttatttgggtggcgtccacaccagccttgtcgaagacctccttgttgtagaagaaagccatagggccagaatccatcggcagaccatacactttgccgccccagtggaccgaggaccaggtgccgggagtgtagaagcccttgtaatcattcgtcttgtcggtaatatcagtcaggtgcttgccgatggcatactgcgggatagccatgtattctatctgggccacatcgggcacgccggagcctgcctgtagtgcattatccaaggcggtgtaagccttgttgccagtgccaacgttctgcaacttgattttgatgttcgggttcttggcctcgaacttcgggaccacgcccttgagcgtaggctcccaggcccacacggtcagctcggtcttcccgccggactcgaaggagctattagaggcttgagatcctccggaaccgcaggccgccaagctggagaccatagcgagaccagttaccagtgccagggttttgcgtgttgtcatggacttcatcgttcccacatccttcccggccgccccatagcggccacgggcgaaacagcgacgccatcaagagccatacacccccacggccaatacacctaaagctcattgctctgcaacctcgcagaccaacggctacatgtctctccagtcgtcgcaacggtgctcactatgatacacgtcacgcaagagcctgagacgacaaaaccgtcgcggcccatgcatccatagaaattgcaagggccgcgacggcactggctgaatggttcttcagtcaatgggctgcgcgtatgctcactgctacacacagcgcttcatcacttgacctcgaaaccctgtcccttggcgtaggaggacatgtccgcctgccaagcggcgatgccgtcggatagcttgtcgctgccagtgaaggacttgccaacgaaatcgccgtacttaccacgggcgtagacctcgaagggcaggaattggtagccggtggagacggagtcagccgccttggcgaggacctcgttgtatttctgcccaccgaagtaatccacgtccttgccgtcggagttcttgacggtagtggtgttgaggaagtcactggacttcatggtcttggtatcggccgggaaggcgccgcccttgacgcggatggaaatgcccttggagtcgtggttggcgaactcgatgaacttgtaagcggcatcggccttcttcgtagacgagatgatgcccagcgaggaaccaccgttctcagcgtccgtggtcttaccgtcgcgggtgggcatgggggccacacgccacttgccagcgccgccagcagcggagttagccagattggcgggcatccaagcgccggacaggagggaggcgattgagccgtcgatcatggccttgaaccaatcctcggaccagccggcggtcttggtgtcgaccagaccttcggaaatcatcttctgccagaactcagtgaacgctttggcgttctcgtctcctgtcagattcagcgtgacattcttgccatcagccgaggtcttgaaggggtggccgccagccagccagaccatggaatcgtagaagccggcatcgcccgagtcggatgtgatgtaggaaccggtggccttaatcttcttggccgcctcatagtagtcatcccagctcttgatctgggtggcgtccacgccagccttatcgaaaacgtccttgttgtagaagaaagccatagggccagaatccatcggcaggccgtaaaccttggaatcccactggaccgaagaccaggtgccgggagtgtagaagccctcgtaaccgctagtcttatccgtgatgtccatcaggtgcttgccaatcgcgtactgcggaatggcatagtactcgacctgtgccacgtcaggggcaccggagccggcctggatggcgttatccagagcagtgtactccttggtgttggtgcccacattctgcagcttaactttgatgttcggattctgggcttcaaactccttgaccacgcccttgagcgtaggctcccaggcccacacggtcagctcggtcttctcaccgctcttgctggagtcggatgagctgccggaaccaccgcaggccgccaaactggacagcatagcgaggcccgccaccaaggccaaccccttcttcaccgctgtaaacttcatcgttcttagtctccttccttcagccgccggatgacggctgcctacacttgcatccgcgacccttgccgctcctctatggcttccgcgaaatgcctcgccgctgaggaccgaccgttcccgccgaagccagcgtcggtcggagagaatggttgcgataacataatttattatacacgtctgtaagtgaaataccgaggaaaaccctagtgtctttctgatatcgcaatcgcaaggcccggagcgatgatccacccctggatgaacctccgctcagcgttcaaggaccaagactccgttggggtcgatggacgcgcggccatccgcccccacccgggccaaggaggccagcaagggctcgccgtcagcctgaaaccgaaccttgtggtcaacacggttgaagaggaagtcgaagcgcttggatccgtccgggctcacacgctccacgcgcagtagggcgccaggatcctcgccctgagcctgcacctccaaccccacggctctcagcagggcaggcaagctcttacccagtccttcacggcccagcttgcaaccgacatatgccgctcggccctgcccgaaggggttcactgtgatggctggtgcaccatccaaaccagtgcgcttatccgcatgataggaagccaggaccgtgacaccagggacgaccgatgtgatcaggtcagccatgccatgcgcaactgccccgttcgtcaggttcacatggtccagagcaccctcgtccgcgcccatcggcgcgaactcctcggcacgcacaccgaccacatcgccaatcgaacccgggtagccgcccagccagatgcgatcggattcgtcggcgaggccagtgtaataggtgacgaacagtttgccaccgccggacacatagctgtgaacccgccgagtattggcttcatccaacaggtagacagccggcaggacagcggcctcgtaggaatcccagggaccgcgtaccggcactacgtcagcggtcaacccctggtcggccagggcccggaaccagtccaaaggctcggtccaatggcgcacctcttgggagggagtggccgtgtactcgctggcccactcgctctcgtagtcgaagacgacagccatctgggacttggccaggcgactaccggccaagccgtggtcggacaggaggcgcaaatcgtcgcccaactcgcacacatcacggaaaatctgggaatcggcgcccgcatgaggaaccatggcggtgtggaacttctcggcgccggagcgggactgccgccactggaagtagcagatggcatccgccccgaaggccagatgggccaaggaatcccgaaccagctggccaggctccttgcggtagttgatgggccgccagttgacggctccagtggagtgctccatcaaccaccaggggtccttacgggctatgccatccaccagcgaagctgaataggccagctcatcgaagtgagcctcgcctggggtgaagtagtgatcgttcgaaacgaagtccacttcagcaccccagtcgtcgtaatccagggtgctgcctgcggccgagaccatgaagttagtggtggccggcaacttcggagcgacctcgtgcaggacatcacgctcagcctgatagaagtccttcaaggcgtcggaactgaagcgcttgaaatccaggagcttccctgggttgatgaaattgccttcgccgatgtatcgggggggcagaatttgtgagaaatcgtccaggttctgagcccagaaggccgtcccccaggcctcattgaccgcctcaatcgtgccatagcggcgatggcaccaaacctggaaggcgcgcatcgcatcgtctgagtagtcaaagcggttgtggcaaccgtattcgttgccaacatgccagccaacgatgaccggattgcccttgtagtgctccgcgatggcacggcagagcttgagggcgtagtcccggtagaccgggctggtggcccgccagtgctggcgggcgccgggccagaccacatcgccgcgttcgtcacgccagaggacctccgggtgagcctgagtgagccacatgggcggggaagcggtggctgtggccatcagcacgctgatgccggcacggccgagcttgccaaccacccgatccagccagccgaaatcataaacaccctcacgcggctccagcttggaccaagagaagatggccaaggagaccacgttgacgccgaccttggccatcaaggcgacatcttcgtcccaaacctcctcgggccactggtcggggttgtaatcgccaccataccagatgcgccctgaccgtccggcggaaggctgcggccaccggtgcgccctgcgcgcggacgcggtcagacccgtctcgttatcgtatttcacgtggaactgttctccccgattggtccgcaaagtatgggttttattccttgacggcgccggcggcgagaccggactgccagtagcgttgcagaaggaggaaagcgatcaccaaggggatgatcgtgaccaggctgccagtgatgaccaggttctgaatcgcttgaccgcccgccgtgctggcctggtccttccactggttcagaccaatcgtcaacgggtaccagtccgcatccttgagcatgatcaacggaaggaagtagttattccaagtcgccacgatcgtgaacaaagccgtcgtcacaatcccaggggccagcaaaggcaggctcacctgcgcgaacgtgcgccattccgacgccccatccacccgcgcagcttccaacaactccgtgggcaccgcctgctcagagaaaatccacatcagatacaagccgaacggcgaaatcaagctcggcagaatcatggcccaaggcgtgttcgtcaaccccagcttggcgaacaacaggaactgtgggaccgccagcgcaatccccggcacgctaatcgcgccaatgatcaccgcgaacacggccttcctgccagggaaacggaacttcgccaacgcgtacccgcccatgatggccagcagcgtggcgccgcccgcgccgacgactacgtagaacaccgtgtttagcagccaccggccgaagatgccatcctggtaagtgaacaccatcaccaagttatcccacaaggcgaagctgtgcccgggtcccaggccgaacgtgctagtgaaatccccctgcgtcttcgtcgcattgatcaacaagtaggcgaacgggaaaaggcagtaaaccgcgaacaccccgcacaccaccgtcatccacacggaacgacgcgggtttgcggggttcgagaacccgctcttgcccgaacgcctgcgctccgcgcgctcatcagcagcgattcgccgccgccgggccctttcaaccttcctggcccctaaccatgactgactggacccgacctggggcccctccgccgccgcactcacttcatctgctccttcatgctgttcaactgcaccgcgtacgcgatgcccatcgtgatcaccgccattacgatcgccaacgccgccgcgtaattgctctggttacccgagaacgacaggttatacgcgtacatgttcggcgtgtaatacgtcgtaatcgcgttacccggcaccatgttctgcaaaatgctcggctcgttgaacaactggaaggaaccgatgatcgagaaaatcaccgtgatcgccagcgagcccttgagttcaggcatcttgacacgcttgactatctgccactcactggcaccgtcaatcgccgccgcctcatacaaggaatgcggaatcgtggacagggacgaatagaagatcaacatgttataccccgtgaactcccacgtgttgatattgccgatcgccgccaggagcacgctgggctgcaacacgtcgatatgcacgcccagccaactattcagcgaacccaccaggccatacttcgcgccatacacgaatccccaaatcaacgcggacaccacagcaggcaccgcgtacggcaggaacgtcgaaatacggaagaacttcgtgccatggagcctcatcgaatccaatgccaacgccatcaacgccgccaacgccaacatcacaggcacctgcaccaccgtgaacaacgccacccggcgcacggaactccaaaactgcccatccctgaacagccgcgtgtaatttgcgaatccactgaacaccgtcccgccgatcatcttctgctggaagaacgagatatacaccgcatacacaatcggaatcacgaacaccagcaagaacactaaggcgaacggccacatgaacttccacccacgccaatccgtccttcgccggtgaaccgtcacctgaggccggcctgcaagcccactcgcatcaagatccccggaagtcatcccaatccctctccctcgaaggccgaccgccgaaaacttacaggagttcagggcagtcactccaaaatgtttgcgttatcatcttaacacttcgcaataatgtaatattgccatacttaaggcctgagcgcacgctgataggtataattggtcaagaaaataccgctcgggaagcttgcagccgatagatcaagaggccgaatcgagatggaacacgcacaacccgcgtctatgcgcgatgtcgccaaggcggcgggcgtctccgcccagacggtctcccgggtggcgaatggttccacggctgtgcgcccccaaacccagcaacgagtggaagcggcgatgaccaagctcggctaccggcccaactacgcggctcgggccctgaaacacggacgcttcaagaacgtgggtgtgctcatgcacaacatgacctcaaacggaaacgtgcgcatcttgaatggaatcgtctcagccgcggcggagagcggctacgcggtgacagttcacaccatcaacgggcaagccaaccagagcctgaactcagccataacccacttccagcaactaccggtggacgcggtggtggccgtgctggaacggcgggttcccgacttcaacgaattcgatccggcaaaagaccttccagtagtcctgatctcggaggacccagctaaccactgcccgacaatcgatgctgaccagtacggttgctccaccgccatcgtcgactatctgctgagcaaggggcatcggaccgtctaccatgtggccggcccctcctggtcgcgcgctgcggagagccgggccaaaggctggagggacgccctgaagcagttcggaatccccctgcctaagacctatgtcggcgactgggaggcggacagcggataccaggccgggctggctctggcccgtgaggaggactgcaccgcgatctacgcggctaacgaccaaatggcctacgggctggtgcaaggactggtagccaacggcaagcgcgtgccccaagatgtgagtgtgatcggcgtggacgactccctgctgggcgtggtgccgcggctgacaatgaccaccatgaggatgaagttcaacgaaatcggccgcgaggccttctcaatggcccgccgccagtgcgaaggcgaggaggtgccggtaggcgtcaagaccgtgatccccgccgagctgatcgagcgcgggtcagtgcgtgacatcagcgagtaagggcccgaacggcttgagaggccgcagggaagaaccttgttcgcgcaaaggaccacaatagaaggcatgagcagagtggacgtgctgaacttgcagaccggcgacgaggtgggaggctacacgctgatcgccccgctgggcggcggggcgatgggctcagtctggcgggtccaggacgacgggggcaccgactacgcgatgaaggtcctgcgggactccctggccgagaaggacggccaggcggatggtcaggggggaacggaccgggcatccgcccgcgagcgcctacgccgggaagccatgtccctgcggcggatcgaccaccccggggtctgccggattgtggacatggagctggacgactcgctggccttcatcgtcaccgaactgatcgaggggctgaacctgagcgacgatgtgtccacgaacggagcctacagcggcgatgacctggagcgcttggccgccaagctgatcgacgcggtggccgccgtccaccgggcgggcatcgtccacagggacatcaagcccacgaacgtgatgatttccgccgccggtccggtcctagtggatttcggcatcgctatgggcgcgggcgaagcgcacgtgacccgcaccgggctcgtgatgggcacgccgggattcatagccccggaggtgatcgatggggccgagtcggacgaggaatcggactggtggagcacggccgcagtattggcttacgcggcctgcggcaagccggtcttcggttcccaacccatgatggccgtgttggaacgggcggcctcgggatcggcggacttaaccgggctgccagcccggaccatggcggctttccgggccgccctcagcccccgcaggcaggacaggcccaggccccaagccctgctggacgccatagggctggacgccctgcaacctgagctctgggagcgggacgacgaaccggacgatcaacaagacagcgaacagggcgaggacagcggcgaaagcggacagagccagcctggcgacgaggaaagcgaaggggtggtgcgcccttttggcgcaagctcttcgactgatcggcgacctgggcccagcggcggcgcgcaggccagcggagttggagatgcgagaaatctgacggccggcgaaaccacgcaggttctagggggcccagcaagcaacccccgcctgacctggcggactcaaaacgtcgatactgctcgcacccaggccctggccgacagcggcccggaggatgcaacgaccctagctggactgacccgcacgctgcccgccaaggaatcggagttgggcgccacggccgactgggacgaagcggaggacggagccgaggacgacgcggaaaagacctgggtcggcggtccttccagcgccacgcggaccctgccagccatgaccacggcgctgccggcggaggttggaggaccaagcctccaagccggaaccatggcccaggcggcgccgcgcatagcgcccgaagcggccgtcccaggccagtacgcggctccagccaccccctatggcccttacgcccaagccccccttgacccccctgccgctgtacgctggagggagcgctacaagcggggcaggccggttctgtggatgatcggcctgctggccgccgccctggccgcactgaccccgttctccgcctgtctactctcctccctggccctatgggcgctggccaccgccggtctgagcctgggcgggcagatgagccgggaactcaagcggggcgatggccgacgccggcgggacgcgcttctgaacctggcaagcctgccctggttggccatcaaagccctcgcgatgaccctgccccgcctgctcatcctcctaaccactgacgccctggggctggcagcaggcggctggctcttgggaacccccaaggtcagcgggaagctggggctcttcggcgccgtcatcccgctccccctagtggctggcaagtcctcatcggcggcgggcctgctggctgccacctgcgcgcttgtcggctggctcctggcggctttcgctggtggcggaggaggggcgtcgaattcagccaccgctcctggcacgaaggattggaggctggcagtgcgcctgggagccggtgccctgccaggcaagggcgcccaggagagggaggcggagcaagcccagcaggcggcggcagcgggcctgagcggccaagcggacccactccaggggactccagcccaggccagccgcaggcgtccgctgattctgctggccctgtgggtgctcatcctaggtgtgttgctggccttcatcgcctcgggcaccaccctggactgggctccaatcacgctcatgcccgcgagctcctgagaccggatgagccctggcgccagcgacctggaaccagcggagcccatcttctcttttcttggctacacttagtgcacgagattggcgaaaggaacgtggatatggcccaaaagcacccccagcagtcccaacaggagcgcacggtgcgcccgaacgcgagctccaaccgggcggccaaagaagcccaggagcgcgcgcaccaggaggaattggcccgggaaggacgccaacagaccatcatcggtgtggtcgcggccgtcatcgttatcgccctggtggccgcaggcggcttcttctactggcgctcgcaccgccctgccgccgaggactcgccctcctcaatcaagcaggcttaccaggcggtggaacaggtcaaagtgaagccccgggacgccaacagccaggggggcttcctcctgtccaaggacggcgtgggcaagagcgtggccggggcccccaccgtggaaatctatatggacttcatgtgccccggttgcgccgcgctcaaccgcagcctggaccccacgttgaacaagatgatggacgcgggtcaactcaacctggaaatctacccgatgagcttcatggaccggctcaccacagacgagtactcggcccgggccggctccgcaggaatctacctgctggagcacgactcgaagcactacatggcgtacatgtcgaacctgtacgcgaaagacttccaacccgacgagtccaactaccagcccgtctcggacgcgcgtctcaaggagcagatgctcaaggccggggtgagcgagcaagtggccgatgaggcgctcaaggggcagtacaaggagtggctgtccaagatgaacaagtacacccccatgcgctccgagctgtggaacacgagcggctcaagcaaggggtcgatgaccaccccgacggtacgcatcaacaagcgtttctggtcggtggactccccatccaaggcgggcatggacacggttagcggcttcctggccgcggttggtctgccggccgctcaggtgggccaagcgggccggatgccgtcgattggggacaagggggcgccgattgcgctcacagcgagttcgcggcagtgacttgagggtcgcccgcagtatgtgctaaggtgaacgaccttgcctgcgtgagagtttgagccctcgaaccaggcggaccggcgtcctgcggacgtgctggcccacaattgaatatgaagcccttgccggattcggtttcgatcgcatggccaaggagcttaggacggttttgggatgtggctcacagaacggccacgtcgttacaaaacaatagtatgctgactgatgcgttgcgcgttcgcatactagcgcactcaccgcctccttagctcagttggccagagcagccgccttgtaagcggcaggtcgtcagttcgaatctgacaggaggctcgctgagaacacttgtctggacacgccttacgggtggcgtccggcctcggccccctcaacgggagcggcccggactaccggcccgcaaacgaatacttctctcgagtaagattccgaaggtttcggcctgcggagacaggacgaagcgctttctccaaccagcttcgtccgtttgcaggggcgggaacatccccttcaatcccgcccctgatttctttgtggaccgtttgtggaggcacaacctccacaaacgcttcacaggtgccccgacaattgtgcatatttacacatgtccgcgcccacctccacggaagccacacatcgcaccgatagagtcgggtctattgcgtgcacgaaaggagcgaccatgagtagacggtggacaccgcagcaattcgtgatcaagcgccgcatccgcgtcatcgcttgcgccgccctggtggccgttgccataatcggctcattcgccttcactgcgcgtaaatcagtggccttgaccgtcaacggtcagacccgtcaggtcaccacctacgcttccagcgtggatgccttgctccagcaagaaggcatcgatcgcaagacccacgacctggttgagacctccgccggcgggcagctggtggaccacgggacagtgaccgtgcagtccgcctaccagaccacgatttcgatcgacggacagcaagtgcccttctggaccaccgccagctcggccgaacagctcctgggcttcttcgaggccaaccgccgcaacgccgccaaggtgagcgtggacatcaagaacgtatacaaccaactaaccggcggactagccatcaaccaggcgggtccggtgaccgtcatagcggacggcaagacatcagtggcgcccgacggcaagttgccggccgcctcgatcctggactccaagggcatagtcctgggcaaggaggaccgcgtctctgcggagaagggcgccggcaccaccatcctgcgcgtacagcgggtcacccacgggcagacgatcaaaatggtggccctgcccttcggcagccgcacggtagttgacaccagcctggccccagggcagaccgtcatccgccagcaaggccaggcgggccagaagaagcagacctaccagaccacattcgtggacggcgaagccgagtcctccatcttgatcaatgaagagaccgtggccgtgccgctggaccagatcatcgccgtcggaccggagcagcaagcagcccaaggcggctcagcggatgccaacaagcagggcggtgagaacgacaagaagaacggagaggataaggacaaggaccagtccagcaagcaagaagcggcgaagcccagccaaaacgacggccagaacggggcctccaccccctcaaagcctacgtccacgcctgcgcccgctcaacctgcgccacccgctcagccagctcctgcgccccccgcaccgccggcccctcccgcgccttccgaaagcggcctgtggcatgccagccccgccgccgcgcaaagtttcgccgccggtgccgccgcccaacgcggctggaccggccagcaattcgatgacctggtgaaactgtggaaccgggaatcgggttggagatggtctgcggaaaaccccggttcaggcgcctatggcatcccccagtccttgcctggcagcaaaatggccgcattcggcgccaactggcgcgatgacgccgccatccagatcgcgtggggtctgagctacatcgcctccgcctacggcaaccccagcgccgcctggcagcactctgagagattcaattggtactgagccccgtgaacgattcgcataagcaaggagagccaggtctgaccgctagtagcgacagcgcctccttcccgctcagcagccccgataccggaaccgaaagcggcctgttaggggccgccgatatccggcgcttggccgcggccgccgacgtgagcccaaccaaaaaacttgggcagaacttcgtgaccgacccagggaccgtgcgccgcatcgtgcgcgaagccagggtgggcgctggctcacgggtggtggaagtgggccctggcctgggctcgctcaccctggggctgctcgaaaccggcgcgcgcgtgtccgccgtcgagattgacccccgcctggcgacccagctgccaaataccattcaatcgtatatgccgcaagccttggaccggttcgatgtgagaacgcgcgacgccctcaccctgagccgggagacagcgccggacctggcccaggcgcccgagctcaccttggtctcgaacttgccctacaacgtggccacacccattatcctgaccttgctggagcgcttcgacaacctcaccggattcttggtcatggtgcagaaggaggtcgccgaccggctgaccgctcagcccgggagcaagacctacggggcgccctcggtcaagctggcctggtacggccaggcacgccccgccggacggattgggcgcgcggtcttttggccggccccgaacgtggactcggccctcgtgtccttcaacagaaccgaggggcgcgagcgcggtcccgaacacgccccagacgaacgggcgcgggtgttctccctcatcgacgccgccttcgcccagcggcgcaagaccctacgcgcagccttgtccggacgcgtggatccgtccgctttcaacgctgcgggcatcgaccccaagcgccggggggagaccctgctcgtggacgaattcgcccgtctggcggccgctgatcccagggacggcgaactcccataacaccgccccgcccgcgccgcgccagcgtcagccggacgggatagagtattgaggcagtcaccgttcagaggggttcaaccatgacgtttcccgatccagcggatgagcgagaggctcgccgccagttcgtccgccgccgccaaaagatggtcttcacaatcgcggtatcggccctggccgtggtgttggtcatcgccctggtcgtcaccctgggcgcggtcggacgctcccaccggcagtcggcccagtccaagcccaattacggggtggctgtgatttgccctcccaaggacgcagccgtgctcaaccatccgaccgtgcgcgtgcgcgtgctcaatggcaccaacaagaccgggttgggaagcgccgtcttgcgggcccttcgcaaccgcggtttcaacatgcaaggtctagcggacttcccgaccaaaaccgagctggcccgcaccgagatccgcttcggcgccaatggcgtggcccagggctacacggtggcaggcctcttcaacgatgcgatcatgcgcatggacgaccggcaggatgacctggtcgacgtggtgatcggcgccaccttcaacgacttggccaaggagaaagagaccccggccgtaggcaagccgatcgaggcgatccggggctgccaatcggacatcaaggacctcggcaccctgcccaagttcaagcagtaacactcagagcgggaatgccggtaatacaggcatagataagcaagcgggggagcggcgaaccactcggattcgccgctcccccgccgtttcgtacgcccctggctcgcttaggggcggcgcgcagaccgtcgggccgaccgcctctgatcctcgggcagggcgtcccaccaggccttgagctctgcctcggcgctggccgggtcgaccgggccgtggtccaaacggtagttcagcatgtgccggtaagccttgcccaccagaggcccaggttccaggccaaggatcgccattatctgctggccgtccaagtcagggcggatggcgtccaggttctccttctttttcaactgccgaacgcggtcctccagctcgtccatggcggcggagaacacctgggctttgcgcttgttgcgcgtggtagcgtcagcccgggtcaagcggttgagccgctcatacagggggccggtctccttggcgtaccggcgcacagccgcatccgtccagcgctcatccacatacccatgaaagcgtaggtgcatggcgatcaggtcgcacacgtcgtcgatgagccgcttgtcgaagcgcaacgccttgaggcgtttgcgggccagtttggcgcccaccgcgtcgtggtggtggaagctgaccttgccaccgggctcgaagcggcgggtggcgggcttcccgatgtcgtgcaggagggcggccatgcgcagggtcaggtcgggagcgggcaccggtccatccgggccggtctcaagcgcgatggcccggtccaggaccatcagcgtatgctcgtagacatccttgtgtcggtggtgttcgtctatctccaactggagggcgggcagctcaggcagcacctggtcagccagccctgaatccaccagggcctcgacgccatcggaggcatgctcgctgagcaggagcttggtcaactcgtcgcgcaccctctcggccgagacgatgctgatccggtctgtcatgtcgctcaacgcttcggcggtctccggggctatgcggaagcccagctgggcgacgaagcggacggcacgcatcatccgcagggggtcatcatcgaaggactgccgggggtccactggcgtgcgcaggacccgtttggacaggtcggaagccccgccgaagggatccacgaactccaggtcgggcacccgcagggccatcgcgttgactgtgaagtcccgccgtgacaggtcgccttccaagctgtctccgtagtccacgtccggcttgcgagagtccggctcgtaccggtcggaccggtaggtggtgacctccaccttcacctcggtcccgtccggccgccgacgcatggcgcctagggtgccgaacttgcggcccatatcccaaaaaccctgcccccaccggcgcaggatgggctcgaagcgctcaggcttggccgaagtgcagaaatccaaatcgtgggaggggcggcgcaggaggaggtcgcgcacagggccgcctaccaaggccagctcgaagccctcctgggcgaacaagcgccccagctccagcgcctcaggccaaacttcaaagtccacaatcaccctttccgcgtatacttgtcatcacgcccgtcgcagcggcgtgagcagtgtatgcgcctaccagcttaccgtcaccccacctgcacaatagcttacgtaaagtggaagttatgactacgcctaccgattttgcgcgcatgctgtcgcgccacgccaaagatcggggcgaccatgccaaaaaaggccagggacccaaggaatccccacggctattccatactttgagcgacgatttggatccggacctgggtcggatggtggagcggctgagccggggccaggaactgggggacggcgagctggaccttgatgcatccgctgccgaggccgacgagacggacggaacctcgaacggacggctgatctccgtttccatccgcgagcacagcagcgaaagggacgacagcgacgcgcccacgcccgcgatcatgccgcgtcaccgccaggagacaggccgcgcctcattcgcctccttgcagacccaagacctgccagtggtgcgcgagtactcggccggtgggctcatcttcgacaaggacaacagggtggccatcatcgccaggcactcgcgctccggtcacatggagtggtgcctgcccaaagggcacatcgagaagggcgagagcccggagcagaccgccgtacgcgaggtgcacgaggaaacaggcatcctggggcgggtggtcgattcaatcgccactatcgactactggttcaccggcagcaaccatcgggtccacaaactggtccatcatttcgtcctggaacagactgggggctggctgaccgtggaaggcgaccccgaccacgaggccgaggacgccacctgggtggacttcgacgacttgaccgacgtcctctcctacccgaacgagcgcaaaatcgcctggctctacgccaagaaaatcaagaggcctcatgactgagagccagcaccgtgggagttccgtcaccccccaggaccgccgcgcccccgcaccgggagcagaccggcggcgacccagcgcacccctaggcgcgttgaccacatcaatccgcgccctgctggcgttccttttggtctgcgccagcatcctgctgccagcgcccgcggccctggcgaacccaggcgaggagattcaagcggcgggcgaacagcgcaagaccgaagagcgcgaggatgagaccaaaaccaagctggccatccggtcctccacgccaatgatctcgtccacgtccggctacgcggcgcgggtggccgtgaccaacacctcgagcgccccccttgatgcgggcagcctaagcgcctccaccaacagcctgtataccttcagctccagaatcgacatgcagggttgggccgaaggaggctcccggatccccacgcccaaccagcttgccgcccagcccgtcggcgtcatccagccagggcaaagcgtggaggtcaccctttccgcccccgccgacgacggatcgatcaaagccatggccacttgggggccgaaacccctgttgctgacataccagagcgggcaggcgggcggctccggcaagcaggtgcgcgcagcgatcagttccttcctgacccgctcgcaagacggcttgaccaccgcccagaccccgccgatgacggtgagcatgcttatgccgctgacgacgaccggctggaccagcgaccaaggcgcggtcaagcgcctgatgaccggtgagcgccaagaggatcaggacagccagggcagcaagcacagcgacggccaagccggtcgcggtgaaggatcgcgtgagcagaccgatcccagccaaatcctaagcctcaatcaggaggcccagaaggtgcagaacagccagatgcaactcgtcagccaccatcccaatctcaatgtggtggccgaccccacctacctggccgcgttcgagaactcgcccaaggtggatgccgtcatgcagcccgccgcattcgacctgaccgcatactccagccaagacgccgcccactacgcttccgccggcgtccaacccaccgtgtggagcgccgaccaaaccggcaaggacctgcaagcggccctgggcgcatcctcgaagaccatcccaacctacgcttggcaagggcggaggtcctggtccatggactcattgacccaggcccgtcagcagggataccagaccgtcgtggcccccctgggcttggacgcgggctccggctcctcggcccacaccggcaagtacacggtacctacagccgccggcgaggtcacggtgctgtcggcccagcaggagttgagcgacctggcgcaagggcaacccacctccaccagagcggcgggcgagcagacgccggccgggcagaccgcccgattcatggcccaatccgccttctaccagatggaacagccttactccgagcggcccctgctggtctgcttcgggaccgaccaagacgccgaagccacgtcggcgctgatggacgcggcggagaaagccccttggctgaagctgagcggacttgacgcgctcaatcaggcccaggcctaccagggcggggaagccgccaaacagaccgtggcccaggcgaatcaggccaacggcggccagagcaaggacaacggactgtccggcacgctggactccctgaccgccagtcggcaggacatctcccgattcggcgagtccatcctagccacccccagccaagcccaatccactccctcggcctccagccggtccgacgcccaagccctggcccggcaagacgcggccaacgcggcccatcgctccgatgacccccgacgctggctcaacgaggtgagcgaggcccacgacaccctggctctgcacaccctggcctgcaccaaccaagctgcaagcctggccgactcggcgcgcgccctagccgaccaacttctcggcggcatacaaataaggccttccgagtccatcaccgtggtctccgagaccgcgacgatgccggtcaccgtctccaactcgcacccttatccggtggccgcccgggtcagcgctaagaccgattcgatggagatcgccaccacgcgcaccgcagacacggtcatccccgccaattccgaagcccaagtgaccttcaccatccgcgtggccaccgccggccaagccaccgctgaaatctccctggtggaccggcagggtcgtcccttcgggcagacgcaggccacccacatcaacagccacctgcgtctgagcgacatgtctggtttaatcatcgtcgtcgcagccctcttgttcggcgccttaggcctgtggcggcagttccatcgcaagaaggacccggacgaatgagccgggcgaaccgggcctcggcccagaaacagacccatgcgcaagcatccttgccggcctcatcctcgccagccccagagcggctgagccaggcggctgagggcaaggattccgtaggacgtaactcaatcatcatggcctccggcacggccgcctcgcgcgtgaccggacagattcgcaccatcctgctggccgccgcgatcggcaccaccggcatcgccgcggacgcctaccaaactggcgccatgatcccccaggtcatgttcaccctgatctcaggaggcatcttcaacgcggtgctggtcccgcagattgtgcgcaccctgaaggaggaggacgccgaggaccggctcaacaagcttataaccgcgtcaatcgccctgctggccggtctgacgctcatcctgatgctgggcacttcggtgctgacctccatctacctgaactcgaaatggaacccagcccagcgcgccctggcgaacgcctttacgctctggtgcatgccacaggtcttcttctacggtctgtacacggtcctcgggcagattctggcggctaaggggcgctttacggcctacgcctggtcctcggtagcggcgaatgccatctcctgcggcggtttcctggccttcatcgccatgttcggcaacgcccagaagcaaccgatggacttttggacgaccgagaaagtggggctcacagccggagcttggaccctgggtgtggccttccaagccctggtcctgttcatcccgctcatccaatccggcttcacctaccggccgcgctgggggctgaagggcatcggcctgcgctcgatgggccccgtggcggcctggagcctgggcgtggtggtcatcgaccagctggcgaatatcgttaacgcccgcattacgaacggtgcgcccctggaaggcgatcccttcgacatcgccggcaacggctcctatcagaacgcctacacgctctacatgctgccctattcgctgatcgccgtctccgtctccaccgctatcttccccctgctctcacaggccatcgccgagaaccgaatcgatgacgcccgtcaggctttgagccgggccctgcgcaatgtgggcctgatgatgtgtttcttcggcgtggtcatgctggtcatcccagtgccaatcatccgcgcgctcctgccctcggtcagcgtgcacgaagccgtcctgatttccggccccctattgggccttacggtgggcttggcggcggtctcggccttcctgctcatacagcgcactttctacgctttcgaggacggcaagcagcctttcatcttcgcggccatctcaaacacgctgcaggtgggcatggtgctggtcgccgtccgcctggctcctccccgctactggaccactctcgtcggcctctctttggccctgagcaacatcgtctcattccccttcctagtgcacatgctcaagcgccggttcgaaggattcctggacggacgacgaatcgtcgccacctattgcaaggccctgctggccgccatcgtggcaggtggcctggccctcctcgtgaagacgccgctgaccaagctcgcaggcgccgaggtaagcgggcgccaggggcacatgagttgggtccaggcggtgttcatctgtctggtcatcagcgtcctggtcggcgcggtctacttcctgctgctctgcctgctgcgcaccagcgaactgaccgaccttctcaacggcctgaccagacgtctgggcgttggcgagaaaaccaacagcaagagcgctcgaaccggttcgataccagctgtttcctccctacccgccgacccgacggcccaggagagcgaactggccgggcagcccatacgcgtcatccggtcctacacccaacccgccatcggctctgagttggaaggggcgctcgagcaaatcgagaatgtggccatggctgacgccggctccatgaatcctcgcgtctggaagcagccagcccgcatcgtccccaaactcccaccccgcaaaaccttgcagcgaaaggccacggagcccgcaacaccaacacccgcaacaccagcagccgccccaatcagccaaacgacaggccagcgggctggcgatcgccaaagcaacctcgcaagtgcccccataccggccgcacccccctcaggagcccccctggccaaacctaccgaaccctctccttccttcgccctcccgtccgaaggcacagcctggccccagccaagcgccctctcgacgcagcccagccccgcagctcacgagaattcaggaaccatggagccttccacctcagatatccttctcgaccgctaccagctcaaaaccctcctcaagcgcggaccgggcctgagcgtatggcaggcgcaagataaagtcctcgataggccctgccagctcttcctggtgaccgacgcctcggccttggagccagtgggtgccgcggcctccgccatggccctgaagcccaaccgccggttcacaccggtctatcaactccatgcgcgcgacggcatcgccctggtcgtcactggcctggacgaaggcacctcactccgagagttcctggagaaccaggagccagcccagcgccccagctttgaagccatccgcaccatcgttggcgaaagcgctcaggacctgaccaccctacgccaggccggcctgaccaacctgtcgctttcgcctagcctgattcgcctggcagcgccacgaatctgcatcgccgacgcatcggtcttctccatgctcaagccctggctaccaagcagaaccgaagacgacaatggcagcgaaagcttggccatccgccaactttccgggatcctctatgccctcttgaccggttcaatccccaatgacagcagcgaatccctatccttgcaagcgcttccggcggacgtgcccgaggcgttcagcatcatttgcgagcgcggcctgggcctgcgcgcacccgagaggcctgcgcccacccgcttagtcaccctggctgagctgaccgccctcctaggctcctggacgccgccggaagagttgggcgaacgcgacatccactggccccaaggctctggaagcgcctcaatcgagaccgtccgcctcaagcccgtagctcaacgcgaccgcctaccaatcccggcttccctgatgataaccgggcgcacggcttcacgcacccttgctgagccgaggtggggggccaaccagctcctcttccccggtcgcggcgaagtgcagatggtcaatcctgccgaatccgatgccgacctcttctccatgttcgacgaacgcaagctccagaaccgtcgctcctcttccgcaccactcgggcagagcgagcgttccacctggccaacacggatggtcgatgccagcgagctacggcgagtcggcagctcagacttcagcgatacggcttccaccacggcgggcggtcagcgttctcttgcaaacaagggcaagcaggagcctgaggacgatcagggcactgatttgttcgcgcggatacccgccaggccgctcgctggccagggcaatcaggccgcgcggtccgcagtgcccgcgatggtgtgggatttcgctgacaccggtgaaatcaacttggcccgcccgcaggagaccgatccggccgacctgccggacaagcaggcggaggacgcacaggccattgcaactggtgccggggccgggtcccctgcccatgcgcaagccgaatccgtactggacctgccgcccagcttcgctcccggcagcgccgaacaagccatcaacgtccgatcgcaacgaggtccattcgggctggacgaacccggcgatgacagagatgacgaagacgacgaggacgtcgcggatgcccgtctattcggccgcttcaccaccaaatccgtggtcatagccgtggcctcatgcctggtggtcataggcctgatctgggcttccctcaccttggttggccaccggcgacccaaggaggggaaagcgtcgggctggccgcaaatgtccaatgtgcccttcccaggccacaagagcgactcatccgactcctcgtccacggcccaaccccagcaacccgaggagggcgagaaagcgggacagaagtccggcgaagcatccccggccccaacggtcaagcatgggaccaagtcagcctcggctgtgcccgcccccaggcagccgaccaacacgactgcctacccaacactcaggcaaaccttcctgagccaccccgccgggcaaccgggcttcgcctggtacgtacacctggacgcgccccacgaggtctcccgtgtggaagtctccatccgccagcagggcgggcacgcccagatcttcgccaatgcgtccgcttcccagcccacgcctggccaatccctagcggacttctcattcgacccctctggcgtcagcagggtcacgctcacaaaaccggtcaccacccaggatttaatcatctgggtcccccaagacggcttgccggcgggagggacactgcatttcaacgaggtcaaagtctactgacaccaatggcttgagcggcgcaagcgaattggtggcggtcaaacgtctgtaccgacttggtgagcgccgagcggttggcagcctttggcctgcctgctgtactacgatgacctagcaagggtttctctgcccgtaagcgaaaggcggacacatggccgacgaccccaccactgccccgaaagtcattaacaacgacccctggtatggctcttacgccgctcgggccgagtccatgcgagcctcggagatacgggccttattcgcggtggctaacaggcccgacgtggtctccctggctggcggaatgccttatctgggtcgtatgccgttcgaccaactggccgaccaagtgacgcaaatgctcagggagcggggcgaggtggcctggcagtacggctcggcccaaggcgacccgcatctgcgcgaggacgtcctgcaaatcatggccctggagggcatcacggacgcccagagcgacgatgtggtcatcactaacggctcccagtcaggcctggacctgatcacccgggtcatgtgcgatccaggcgatgtggtgctggccgaggcgcccaactaagtaggagccctgggtgttttccaatccttccaggtcgaggtcgccaacgtgcccatggacgcggatgggctgattcccgaggctttcgaagaagcgattcaggcccaacgtcgtcagggcaaacgggtcaaaatgctctatacggtccccaatttccacaatccagctggtgtgacgatgagcttggagcggcgcccgcgcatccttgacatcgcccaccgggagcatgtgctgatcctggaagacaacccctacggcctgctcggttttgacggccgcacctaccccgccttacgctccatggatccagatggcgtcgtctacctctcctccttctccaaaatcatcgccccaggcatgcgcgtggcctggatgctggccccacccggcatccgccaaaaactggtcctggctaacgagtccgccatcctctgcccttcgaatatgagccagatgaccatcaccagctacctggataacttcgactggcgcgggcagatagaagactacagaagcatgtaccgggagcgcagggacgcgatggatgccgccttgagcgaatacctgcctttctgctcatggaacaagccccagggaggcttctacatttggctgcgcatcccggaagggttggacgccaaagccatgctgccgcgcgccatcgccgccaaggtggcctatgtctccggcaccgctttttacaatgacggccagggcgccgaccatatgcggctctccttctgctatcccacaccggagcgcatccgagagggcatcaggcgcctggccggcgtcatcgaccgcgagctggaaaccgtccagctcttcgagggcgcgaaacaagaggcaagcaagttcccagcaaccctagaccagcaggaggaacgatgagcgagcgcgaaacgaatgcgggcccaaaccccggccaggcctcaattctcgtcgtctgcggtgggctgagcaccgagcgtgacgtctccctgagctcaggccatcgggtccggggtttcctcagggaagcgggctggcaggtgaccatccacgacttggatcagaccctgctggactacctgacggccccggcaacacgcccggacctggtctggcctctcctgcacggggccgacggggaggacggctccattcgcgacattctcgatatgaccggccttccctacatcggttcccgcgctaaggcctcgcgcacagcttggaacaagcccatcgccaagaacgtagtgcgccaggccggcctgtccaccccccactcagtcacactcccagaatcgattttccgcgagctaggcgcccggcagatcgtggatctgatggttgaatccctcgggctgcccctgttcgttaaacccagtgaaggtggatcggccatgggttgctcgttggttgacacaccggatcggttgccgcaggctttgattaattgcttcgcttacggaccagtcgccctgatcgagcaggccgtcaacggcaccgaaatctccgtctcggtcctggagattgacggccggctacgcgccctaccaccactggagatttggacgcccgacggcatctacaattacgaagcaagagccacgcccggaccaaccaagttctatgcgcccgcccggctgagccggcagaccttggcaaaggcccaggaagccgccttgaccgcccaccgcgccctgggcctacgcgacatctcacgagccgacttcatcgtcgatgcctcaggccttcctctcttcctggagtcgaatgtggcgcccggcatgaccgctacctcacagttaccccagtcggccttggccgccggatactccctgcctgagctttactccagcttggttcgatcagcgctttcgccaggccgttctgacagccccaacgccggctccgaatcattccgggagccaggcttgccttccattgcttgacgaacctgcggagccgcgaagtcagggtcgtctttcggtagccagagcctgaatgaataccatttgtcttgatcgcgcccttgatcgccctcgtgtttagcgggattggaccgcatcagtttatcgatttgccaaaacaccacgcccaccacaaccgcggtgccgaggttcgccacaagcactacgattgcgatgatcagggtcttgctatccatacgctctaccatacttcccgcccagcctagaggcccgcaaggctcacattcagcctcaggcaagagcggtcagaaaggctggctagagtgtaggacatgagtgaacaagtacgcgacgcaatcgtcatcggctccggacccgcaggctacacggcagccatctacctagccagggccggctatcaacccttggtcatcgccggcgcggtcaccccgggaggccagctggtcaacacgaccgaggtggagaactatccaggattccctgaaggcgttctcggccctgacctgatggaccgcatgcgcgagcaagccgagcgtttcggagcccaaattgagtatgaagatgtgaccgaaacggacctctccggtccaatcaagaccgtcatcaccgacgggggcgagcgttaccaagcgaaagcggtcgtcatcaccaccggctccgactaccgcaagctcgacattccaggtgagcgtgagttcggtggccgcggcgtctcctactgcgccacctgcgatggcttcttcttcaaagacaagccgatcgcggtgattggcggcggtgactctgccatgactgacgctgacttcctgacccgtttcgggtcttcggtcacggtgattcatcgccgagaaggcttccgcgcttccaaaatcatggtggatagggctcaggccaaccccaaaatcgacttcatcctcaatgctgtagccactcgcatcaacggcagcgcccaaggggtcgaatccctggacttgcttgacacggtgaccggtgaaacgcgccagctcccagtcaacggcatcttcgtggccataggccataccccacagaccgcgttcctgaacggaagccttgccttggacaagcagggatacatcgaagtggagggcgcctccaccctgacttccgtcccaggcgtcttcgcagccggcgacgcggtggacagcgtctatcgtcaggccatctccgcagccggcatgggttgccgggccgccctcgacgctcagggctacctgactcgcctggatcccgcctaggcggggttcactggctcacttccggccccatacggcaaagcccgcaagcgcaaatatcgcttgcgggcttccccataccgttgtttactgtgagtcagacccagccgtcatgattcgctgcctcagagccttggagactcgacccttgccccgcgagcaagagggacagaattcggttcatatcgtctggcgaggagaaggtaatctctatcctcccccgccgttcgctgcccttgatgtcgaccttggtctcaaacctgtcctccaggttgtgcaggattggcgaaccagcccacgcgctagccgcccgcttgcgaggctttttctcggacgcatgggtcttgagcgccaccagttcctcagtcgaacgcactgacagcccttctgcgatgatcctgtcagccaaggcctccatgtcggcttcagtgggcagagtgagcagggcgcgtgcatgccccgccgaaaggacaccggattcgaccttcttctggacactgagcggtagtttcagcagacgaagcgtattcgcaatctgtggccgcgacttggagatggatttcgacaactcctcctgagtcatgccaaattcatccatcatctgctggtaggcagccgcctcttccaagggattcagggccacacgatgcagattctcaagcagggcatcgcggagcatctcatcgtccgtggtcgtcttaacgatggccggtatggtcttcagccccgctaatacgctcgccctccagcgcctctcgcccatgatgatttcataggtggttgcggaggaaagttcgcctctcactggcttctttggagccttcctaacgacgattggctggagaagccctacttcagtaatcgatcgagagagctccagcaactcatcctcatcaaagattcgcctgggctgttcggaattggcgcggatatcatccacgttcaactccgctaagtagccacctgcgactggctggagatcattgtccgccgccgattcacctgctgcgccaacgactgcgccgacggtggattttccggtatcaccagcgctcgctccggaaccattgggggccgtatcatccccagcgccgaagaaaaggtcgctaggatgctccaactcgcttaattgaggcactggcattcggttaatccgtgacttcttggccgatgtttcacgtgaaacatttttgctgctgttgggctttccgctgccagcagccgaagacgtcttggaggaattcccggcctccgacttcgcggcggcaacccgcgactccttaccggctttcgctcccccgctggtctccgcctttttaccacgaattgtcttcgcggacaccgtttcactggtcttgacttctttagtctcagccttgtccaaggtggccgatgcctgcttggatggggcgacctggggatccccgcttcccacatcctccaagccatccaatggtgtttcaccagggagcgcagggaaaagtgcaccaaggccctttcccagtcttgaacgtttcgccatcactcactctcccaactggactgcttcttgctgatcatgttcaggactcgtttcgaccgttcggcgatctccagggcggcttcactatacgaaattgcgcccgcccctcgcgggtcatacgaaataatcgattcgccaaagctgggcgcttccgaaatcttaaccgaccggggaatggtcgtcttcaagacgatctgcggatagtgctctttcacctcgtcgtagacttccctactcagcaaggtccgacggtcatacatggtgatcagcatcgtcgagacgattaaggacctgttatagttctcctgaaccagctcaatggtgtggaggagctgctggaggccctcgagtgcgtaatactcagcctgcaccggtatcaaaacctcagtaacggcgcacatagcgttgaggaccagaagccctagacttggcgggcagtctacaattacatagtcgtaatgaacctggctctcggccaagaattgggaaagcgccctgttgagcaagaggttccgctccggcagattcgccacctccagctccgtgcccgacaagtctatcgaggcaggcactaaatccagggtagggaacaccgtgctgggacgctttgcttgcccgataccgatcctgccctcgatgacatcgtaggtggtggccatatcatgagttcgctgggcacccagcgctgtcgaagcgttcccttgcgggtccatgtcgatgacgaggacttgcgctccattctcagcgagagccgcggccagattcacggccgttgtcgtcttacctacaccgcccttttgattggcgaccgcaatcaatcgagtctgcggaggcttcgggaacacgacattctggagggccgcgaaccgcgatgtcagattagcgatctcagcgccgactgaaaattcgtcgtcccccttggcgaagatgcggtttagcacgtccgatgccgattcgatcttcggtctcggtggcataccgcccgcccggcttttatccgggcgcacccgttttcctttcgccttggtcacctgactatcctcctttgtccttattcaagtttcttgccacagctggacataaaccgttccacagtcttacccacaagcctgtggataagtgtggataaacgcatcaagcattgcgcacattgctcaaactcaccaaaagctcagcagcgctcaatgtcaatgattccaggacttctctccatcatactagacgaaaggcgcagtccagtctccgaatgtggacaactttttacgttcttttaaattgtgcataactcgctaccgtgggtttccttatgccctttacaaaaggtttcacgtgaaacactctggcatcgagaatcatccagcaccttcggctgtttcatgctgatcctcccccaaacgacatctttccccgccgcccctcatccactatctcaggaacgcagttcagagtgtcaggttcttccttatttttttggcggtacgaatacagaggagaaatacagccgccccggaagaatgattcctacgactcctgaattgaccgtacgcatcttacgagggcacgacactcaaggcctttcgctgaatgtttcacgtgaaacattcagccccaaccatcgacacccgcgacttgccgccgctcaggcttcactctcccaatgcttgaagcacctgcgaaaacacgcgcgcagccacgaatgcacactaccgccgccagatgaagtcgacgagttgacggtcaacctgactgctctcgtgcagattgctatgagccgcgtcaggtcctgtaatcttcaactcacgatacgacttcgcacgcccaccggtcaagtaacgcaaagctctggaggatgcattgctgacctgaccatctgagtgcgtgccgtcacccttgtccccataaatgttcagaatttcggccgactgtgggtaggtattccgcagagacagtagggccttgaactcgggcgtctgcggtgacggcagtcccgcagcatcaaaggtcatctggtttggctgatcgtcaacgccgataatcccattgaaattgccagccaagtccacctgcttccgtaactgaggcagggaagcatcccccgccgtatcacgcaagtaattagccaggaccatattccccatggaatgagctacaacattgtagcgttcgaacgggtagacggcatggactgtggtgacaacactcttgaaccactgcccacaaagcgtgtaatccgcgtttgtgttatcgacgaacgagacctcaatcagcgggtttcgcgctgattgaggcagattggatgtcatcgtcgcttgtccggaagggctcacgcccacacggaccatggttttagtaacgcccgcgtcctgaaccgcattgaccatatgggtctctgacttgtaggacccgctccaaccatgcaaaaagaaggtaggcacctcttcttgggcaaagccagaaaggggctcacgtcggatcttgccgctgacaggaatggctacggacaaggcaatcgccagcacgacaacgcacagcaccagcacggcttttcctgccacacgcctgctcttggacatgccgcctccttaagaaccaccggcactccaacctagctcaatcaccggatcgttgaaacgggtagcacatgggacaaagccccattaattcactagactttgtcgactaaaaccacatgcgtcgactccaagcccggtccgaccgccgcttccacgacacgagcgtcccggcccccgtacttacgaagctccttggacgctttgtctatttccgcctgagcggacttccccttgagagccacaagcctgccccctggtgccacaagaggcaaagcccagccagccaatttcgtcattggggcgacagcccggcaagtgacgacggcgaacggcgctggaacagcactatgcgtgggctgcatcgaaccggttcgaggagctccctttcgctcattcctagccctatggcgctttcgctcactcccgctcgatgccctcggagcgaccaattcctcggccctagcgcgcagaatcgacgcattacccaggcccatctcttcgaccgcttcagtgagccaaaccacccggcgctccatcggctcaatgagagtgaactcgcactcaggcatgcaggccgccagaaccaatccagggaaaccgcccccagagcccaaatcggctacacgcatcgagccggcggccctgcaggcgtccctcacgaacgggacggcagcggcggagttaaggatgtgccgctcccagataatcccagcgtcccgaggcccgataatgccgcgctccaggccctgctcaaacagtttggcgtggaatcgctccaagggccccagggccggtcccaacagctccgacaagagaggggagccatccagctgatcgacggacgcggcggctcccgcacttcccgtaagcgcgttctcaccgacctcagcctcagcgtccgcaaggacctgcgactccccctcgtccgtcatcagcgctcgtcttcctcagcctgatcggcatcgtccttaagttcgtccacgccctccgcagcatcaaccttggggtacaccgtcacatacctgtggggctcctccccgtgggagcgagatttgagcccctcctcgcgcaccatatcgtgcacgatcttgcgctcaaaggagttcattggctccaggtccaccggctcgccggtctcccccgcctcgtcaatcgcgtcaagggcggtccgccgcagcttcttgcgcttgcggctcaggaatccgtccacatcgatgatcaaatgcgaacgctcgcccgtgcgctgctgcacagccaggcgggtcagcctctgcagggcatcgacaacatccccatcctgcccgatcaggtgctgtatgtccgtgtcgtcatcggccacgatctggacggtcggacggtggttgcgcacgcccatctcgatgtcgccctcataatcgacgatgtcaagcaaatcctcaaggtagtcggcggctatgtcggcctcctcgttgagctgctccatgctcttgtcttgatccaagtcttgggacatttgccccgctccttactcgtgtctgtccgcgccccggcgttccctaccttggggacggccggtcaggaccttaatccgaccgccggcacgcgcgtactcgcttgatttccaagaatactcatcgcctgtcccaaaagggtcggcccgagccacctggcacttcagcccttgcgccgcttgcggtggggctgttcgcgctggtgggagaccttcttacccgacctggcctcttcctccatctgcttgagcttggccagctcctcctcctcgatcgagggaaggcccttacgcgcgcggcggttgttttcgcgccggtggtcgcgctcctccttctcctcggcagccggggagcccggagtgggcatatggtagacctggaagagggtctgcccaaggttccacaggttgttggtcaaccagtaaatcagcacggcgaaggggaaggccacgcctgagaagatgtacatgaccgggaagaagtaggccatcatcttctgcattttgtactgctggccctccattgaggcgcgcggcaagttctttcgcacattgtggaactgtgagtagaacatagccaggcacatcagggcgatgaagacgacgatgacggccttgccggccccctgggccgtcgtgaggttgtcggagatcttgaggccgaagaaggtcgtctcctcgaactccttggaaacgtccttggtgaaggcgcccagggggtcgtgcgtgccatgcgcgatgaagggcaccgcggagagcacgtagaacatggtcatgaagatagggctctgaatcagcgccggcaggcaagagcccactgggttcacgtgattgtcctggtagagcttcatggtctcccggctcatcgcttcgcgcgaggcgggatcctgcttgttcttgtacttgttctggatcttcatcagcttaggctggagggcctgcatgcgttgcatggagcgcatctgcttgatgaacaggggcaggatcagcaagcggacgaaaatcaccaaaagcacgactgagagcgcccaggccaggccgggcccttcctcgaagcccacgaaggtcaaggctttatggcaccagaccatcacataggtcatcaaccattcgattgggcgcagaatcttatagaagaagccgaagatgccctcgtcgaaggtgaaggtgttgtagttgcggaacatcgttagatagtctccttaagcgaagccatgggctttgtaccgccccgggcccaagccagggggaccagccgaggctcttcgtgggctttggaccaacggaatcggtagaagagagagaagcgggcgggcacatcatcgatgccgccgttggaccagggccggcagcgcaggaggcgcaggactgccagcgcccctcctttgcaggctccgaacctttcaatcgcggtgagcgcgtaggtggagcaggtgggatagtagcggcagcaggggggcgaaaggggtgagagtgaacgccggtaccaggccacggctttgagggcccaacgggcggctaaacttggccttacgccctcgaccggtttgtcctccccgcgctcggcgggctcgcgcttggcttgcttcatggccgttcgcccaccttgcctgctctggtgccggcatcaccggaccggttgcccggtcggcgccccttgctggcgacatcggcgaagagccggcccacttgctcgtccaaggcctggtagcgggctctcgccgcgctcggtttagcccgaatcaccaggtcgcactcctgagggaggctgtcctcgtgggcgcgggccagggcgcggagacgccgtttcacccggttcctgacgaccgcgttacccacggacttggaaacggccaaccctatccgtcggccgcctggcgtaccttgacctgcttcggcctgccttggcctgcggttgcgcgctgcatcctcaccggtcagcaggtgaatgaccacatcacgactggagacccgttgccgccgccgcaggaccgcagtgaactcacgatggctcctcagccgttccacctcgacgcctggactggtctcaggcggagagggtcttgcggcccttggccctgcgacggttgatcagggcgcggcccgagcgggtgcgcatacgggcgcggaaaccgtgcttcatgtgacgacggcggttgttgggctggaaagtcctcttcatatcaacgctcctagtactagccacgcagagggcatggctcctcatatgagttcaagctctactaaagtacaagccgagggggacgaaagcaaaaatcatccgtctcttcggccctgacccgccttatcacagtgcgggcgggaccggcggtaacccttatcagggggccgttccgagaccgtaatttatccacaaacaacacaagcgttgttcacaatcggccccctgcaacacgcaaggctgtggataagcgaccatgccgcgtgccattatggactggttatatctccgggtggcgcgcggacagtttgaagcacccaaccacgggagctagtgagcgatagagaggaggagggcatggccgacgatcagcaggatcctgcccaacaagcgcgttcgatctggcaagctgcctcccaagccttggcgttcagcgccacgctcaccgcccgcgacaagggttggctggccgacatcacccccgaagccgtcttcggcaacacaatcgtcctctccgtctcttcacgggcagcccagacggccatccaaggggatctgggcgacaccctggtcaaggccctgaacctggtctcagggaaagacatgatcccggccatcaaaatcgtgcgagaccggcccgcccaagcagaagcagcccctcaggaggcgcctggaccggcggcgcccgtccaggcgagcggccacgaccaggcgaaacaccaagccaggcagtcggaccggagccagcccgcggcccaggacgaagcccgcgcccaggccgagcgcacggctcaaacctcagaccctaaccccccggcgcaggtcacgcaaaaccaaacggcgcaggcccctcagacccccgagtcccttcatcgcgacgagaacccggacgagcgcgcccaccgctccgcgcaggattccccaacggagcaaacgcccgaagcagagcataggtcttaccgccagcagactttcgcggagcaaagcgactccaaccaacaggatttcactccccccacgttcccgatgggcaccaaccaggtggaacgcgaccccgaaacccatctgaacaagtccgctaccttcgccaccttcgtgcccggcgactccaaccgcttcgcccgcacggtggcgatggccgtggccgagggatcgggccaggatttcaaccccttgtgcatctacggagcctcgggactgggcaagacccacttgctcaacgcgatcggaaactacgccctggtcaaggacccggggctgaaggtgcgctacgtgacgagcgaggagttcacgaacgagttcatcgaggccttgcaggacccgaaccggagccagggtcagattgccgccttcaaccgccgttaccggcaggtggacgtgctcctgattgatgacatccagttcctgggcggcaaggacgccaccctggagcagttcttccatacgttcaacgccctgcacgacgcgaataagcgcatcgtcatcgcctcggatgtggcccctaagaacctgaaagggttcgaggaacggctgatttcgcgtttcgattccgggatgccggtggacatcaaaccgccggaccgggagacccgggtggcgattcttcgcatgctggcgggcaccatgggcattgcgatccccaacgaggtcttcgacctgatcgccgagcgcttcaccgagaacatccgtgagctggagggcgcgctgacccgtgtgacggccgtggcctccctgaacaaccagcccgtcacccaaaccctggccgagcagacgctccaggactacttcgccacggatgtggagatcaagccaaccgacatcatctcccaggtggccaagtacttccacctgaccttcgatgaccttgtggggcgcaccaggaccaagaacatcgccatggcccgtcagatcgccatgtacctggcccgggagatgacctcaatgtccctggtcgacataggcgaggtcttcggcggccgtgaccatacgacggtcatgcacgcctatacccgcatctctaacgaaatgcaggagaagcgtgagatctacaactacgtcatggaactgacggtccggcttaagcagcctcagaacgattaagcgacacgcctaagaagtggatattatcaaagaagttatccacatgcttatccccagatgtgggcaaatcctggggatggagcctttcttttcagtggacaagccgtgagcgtattgcgcgcaaaagccgtaaaaatgtggacagacgaaagcctcgccggcgactgtgcgtaaccttctgatttattcaccgtaattaacaatttccttgacaacaaaaaactatccacattcgcggcctgccgctctttttaaggtttatccacactttccaccgcgcttattactacgactaccccaggtaagtaaaatcccgtcattctcattatcaattccgccccgcgccattctcagtaagtgctggaggctcccgctagaataaaaacagcgaacgtacagcccatccccgaagaaggcctctatgaaagtcgaaatcaactcgcacgcattctccgacgccgtagcctggacgaccagggtcatcccagcccgccctgccacgcccatactcgctggcgtacgcctggaggcggccgaaggaaccttgaacctctcagcattcgactacgagacctcagcccgccaccatatcgaggccggcattgatgaacccggatccgtcctcgtccagggcaagcttctggccgacatcgccaaatccctgcccgccgagaaggcctacctctcgactgagggttccaaaatcaccatttcctcgggtaaatccactttcaccatgcagttgatgcccgattccgaataccccgcccttcctcaactgccgagccaacttggccaggtggacgcgcaaaccttcgcccaagccgtctcccaggcaatcgtgtcggtatccagggaggagaaccggccagtcctgaccggcgtgaaaatccaaatcagcggcgacaaggtcatcatgaccgccaccgaccgcttccgcctctcccagtcatccttcacctggaccccccaggatgccgacgccgaggccaccctgctggtgcggggctccctcctgagggacatctcgcgctccctggatgagtaccagaacgtcgtcctggactttaccccggacgaccctaagatcgtaggcattgagaacgctggccgggtcaccacttgccagctgatcgacggcgaattcccgacggtcgatcgcctcttctccgacgagtaccccattcaggcggtggtcggccgtcaggtcctcctggacgccatcaagcgagtatccttggtggccgagcgcaatgccccgatccgcatgatcttcagcggccacgaggtgaccctgtccgccggcgccgccgatgaggcccaggctcatgaggttttggacgtggacctggacggggaggacatcaccgtggccttcaatcccacctacttgatcgaaggtctgtccgccatagaagagcccttcgtgcgcatgaagatgacctcggcggtcaaggccgtggaattcaacggtcagcaggaggccgattcggacgaatccatggactaccgctacctgctggtgcccatgcgtttcaacgtctgagcgctcttacgcaaagcagtcaaggaggtagcggggcagtgcgcatctcacggttggccgtggaccacttccgctcctggcaggccctggtgctcgatttggagccaggcgtcaacatcctccagggacgcaacggcttgggcaagaccaacctggtggaggccttggaggtcttgtccactgggtcgagccaccgggcctcttcctcggctcccctggtccaaaggggccaggcccgggccacggtccgagcgaacgcccaggaggccgggcgtacgaccacttatgagctgaccatcccggtccggggcgccaaccgcgcccgcatcgacggcggaccctccctctacatgcgcgacttggtaggccgggtcccctcagtcacgttctcccccgaggatcagcgcctggtctccggcgatccctccgggcggcgctccttcctggatcagaccgcctcacagctggacccggcttactatcaggccaagcaggatgtctcccacttggcccagcagcgcagcgccctcttgaaacggctctcccgagccgagagcgccggcgccgatgaaggggaccgacaggcggatttgagcggcttggaggtgtggaccgggcagttcatccaacgggggatggacctgaccgcccgccgtcagcggctggttcagaccctgcaaggacccctggcccaaatatacgagcgcttggccggggcgggccaagaagcgtcgatgacctatgagccctccttcgcggaggtcttgcaagcggggcccgggcccgaggccgccgctgaaatcagccgccacttccagcgggtctggccgggtgagctggcccgaggggtcaaccttttagggccacagcgtgatgacctttccttcagcctcaatggcttgccggccaaggaatacgcctccaacggcgaggagtggaccctggccttggccctgcgcttggccgagcaccagatcctgtcgcaggagggcgggcaggcgcccatcctcatcctggacgatgtcttcgcccagttggatgacgagcgtcgcgggcagattctggatttcgccagggagcagcctcaggccctgatcacggtcgccgctcctggcgatttgccggccttggagggcgcccacctgatcaatgtggcccagttggcgcagcgtcagcgcgaggccctgggggaggcggaggcgtgaggaagccagtcgaccaaagtcttggtctgaatcccagcaagctgccagcgcaggttttccgtcgtttcgtggtgcgcagcctcagccgcaaggagcgtctgcacgacgccgaattggcctgggaatccttcggcaagcccggccgcgacccgaagcgcttgggctcggtgactacgtcgatggcaggccaaggcgggtggttcccccacttgaaagtggcccagctccaagaccactgggatcaagtagtgggccccgcgatcgccgctcactccaccgtgcgctcctacaaggaaggacgtttggtccttcaagcctccacaccggtgtgggccacccagctgacctacctgattccccagctcaagtccacggtcgccgcccgtctggggatgcccgtcactgaggtggtcgtctccggccctggctccggctctggttccaggggaacacacgcctgggtgcgcccccaccgccgctggtaggccaatagcgggcgcgcattgcgtcctgagccacttcaagagcccgcaggaggtcttccgtcgcctgtggctggtaggatacgtatagatagttgaacgtgcgtgagagccttttttgtgcgttctagagcgtaagacccttatctcgaccctagcaaacagagccgagggcctaggaaggaaactctgtggcagagcggaatgcggatcagtcccaggattcgcgcgtcccagaagacgggcaggagcggctgacggacgcccaattggacgattcattggctccggaacactatgacgccagtgatttgcgggtcttggaggggttggaggccgtgcggatcaggccgggcatgtacattggctcgaccggcccgaggggcctgcatcacctggtttacgagatcgtcgacaattcagtggatgaggccctggctggttatgccgaccatatagaagtgaccatcctgtccgacggtggcatccgagtggacgacaacggacgcggcatccccgtggacgaagtgccaggcgagggtgtttccggcgtggagaccgtgatgaccaagcttcacgccgggggcaaattcggcggtggcggctacgctgtctccggtggcctgcatggcgtgggcatctcagtggtgaacgccttgtccacccgcatcgagattgaggtgcgccggcagggcttccactggaggcagacctacgtggaccaacaacccgtggccgccttgtccaaggacgagccgatgaccgcggacgagtccactggcacctcggtgactttctgggccgatccgaagatctttgagaccaccgaatacgatttcgagaccctgcgcgcccgcttccaacagatggccttcctcaacaagggcctgcgcctgaccttgaccgacgagcgcccgagcgagcaggccggcgacgaggtggccggcgaggatggagccgagggtcagccgcaaacggtctcctaccgctatgagaacggcatccgcgactatgtggccttcctggtcaattcaaagaaagccacgccagtcgaggacgacatcatcgatttcgaggccgaggacctgaccctggggatctccgccgaggtggccatgcagtggaccggggcctactccgagtccgtgcataccttcgccaacacgatttccaccaccgagggcggtgctcacgaggagggattccgcgcggccctgaccatgatggtcaaccgttacgcccgcgagaagggcatcctgaaagacaaggatgagaaactctcgggcgacgacgtgcgcgagggactgaccgccgtggtctcggtcaagatgaccaacccccagttcgaggggcagaccaagaccaagctgggcaaccccgaggccaagaccttcgtccagcgggtgatgaccgagcgcttgaccgactggtttgacgcccacccgggggaggccaaggccatcgtccagaaggccattgacgcctccagggcccgaatcgccgccaagaaggcgcgtgagtccacccggcgcaagtccatcttcgagaccgccggcatgcccgacaagctcaaggactgccagtccaacgatcccgaggagtgcgagctcttcatcgtcgagggtgattcggcaggcggctcggccatccagggccgcaacccactgacccaggccatcctgcccctgcgcggcaagattttgaacaccgagcgcgcatccctggaccgcatgatgaagtccgacacgatcgagtccctgattaccgcggtcgggggaggttatggcgaggacttcgacctgtccaaggtgcgctatcacaaggtcatcatcatggccgacgccgatgtggacggcgcccacatcgccaccctgaacctgaccctcttcttccgctacatgcggccgatgatcacggccggttacgtctatgtggccatgccgccgctctaccggctcaagtggaccaagggcccgcacgacttcgtctacaccgacgccgagcgtgaccgcgtgctggccgaaggcaaggagaagggccggcagctgcccaagggcgaaggcatccagcgctataagggtctgggagagatgagctaccaggagctctgggagaccaccatggaccccaaccaccgaatcttgaagaagattcatattgaggacgcggcccaggccgacgagaccttcacgatgctgatgggtgacgaagtcgaaccccgtcgcatcttcatccagcgcaacgccaaggacgctcgcttcgtggacgcctgagccagggagcggcggggcgggcgcgcggcacctcccccgccggccccggccgcagcggacaagcttgaatcatcttctatttgtgatgtaaggaccgacagtggcagacgagaacaacagcaacaacaacgacgacgatgggctcatcctgcccgacggctcgcgcgaacccctgagcccccaagagatggacaacaccgactatgggctgctcaagggcgagaggattcaaccgatcgacctgcagaaggagatgaaggactcatacctgtcctacgccatctccgtgattgtcgagcgcgccctgcctgatgtgcgcgacggcatgaagccggtgcatcgcagggtcatctacgccatgtacgacggaggctaccggcccgaccggggctacaacaagtgctcgcgcgtggtcggtgacgtgatgggcaagtaccacccccatggcgacgcggccatctacgacacgattgtgcgcctggcccaatcctggtccatgcgctaccccctgatcgacggccagggcaacttcggctcccccggcgacgatcccgcggccgccatgcgctacaccgagtgccgtatggctccgctggccatggagatggtgcgcgacatcgacaaggacacggtcgatttcatccccaactacgacggcaagacccaggagcccacggtcctgccctcccgcttccccaacctgctggtcaacggttcagccggcatcgcggtgggcatggccacgaacatccctccgcacaacatgggcgagatcgcccgaggcgtccactgggccctggaccacccggacgcgaccaaggaagagctcctggacgccttgatttccatcattaagggccctgacttcccgaccggcgcaacgatcctgggtcacaagggcatcgagcaagcctaccgcaccggtcgcgggctcatcaccatgcgcgccgtggtcaacaccgaggagatcaagggccgcatgtgcctggtggtcaccgagctgccctaccaggtgaacccggaccggttggtcgtctccatccgcgaggcggtgcgcgacggcaagatccagggcatcgccgacatgagggacgagacctcgggccgcaccggccagcgcctggtgctcgtgctcaagcgcgacgccgtgcccaaggtggttctgaacaacctgtacaagcactcccagctccagcagacgttcggggccaacatgctggccctggtggacggcgtgccccgcaccctgagcctggacgccttcatccgccattgggtggaccaccagctggacgtgatcgagcgccgcaccaagtatttgaagcgcgaggccgaggaacgcgaccacatcctccagggctacctgaaggccctggacatgatcgaagaagtcatcgccctgattcgccgttccaaggatgtggagagcgcccgcaccgggctgatggatctgctaggcgtggacgaagtccaggccgacgcgatcctggccatgcagctgcgccgtctggccgccctggagcgtcagaagatcgtggacgagcacaacgaactgatgcgccggatcaaggattacaacgacatcctcgccgaccccttgcgtcagcggcggatcgtgggcgatgagatggacgagatcgtcgagaagtacggcgacgagcggcgcactaagattctgccttactcgggcgagatgaacgtggaggatctgatcgccgacgagaacgtcgtggtcacggtcacccactccggtttcgtcaagcgcaccaaggccgatgaataccgggcccagcatcgtggaggaaagggcatcaagggcaccaagctgcgcgaggcggatgtggtggaccacttcttcctgacctccacccacaattggcttctcttcttcacgaacaagggtcgggtctaccggctcaaagcctacgagttgcccgagggctcacgtgactccaaaggccagcatgtggccaacctccttcagctggccccaggcgagcagatcgagcaggtcctctccttgcgctcttacgatgacgccgactacttggtcttggccacgcgcagcggcaaggtcaagaagacccgtctgtccgaatacgattcccctcgtcagggcggcctgatcgcgatgcgcctggtgcagttggaggacgagaatgggcggcccttgacccgtccggccgatgcgaccgacgaaaacggtggtgaggagccggtctacgacgagctggtcggcgccgccctgtgcaacgcccaggatgacatcatcctggtctccaggcatggcatgagcgtcaagttcgaggccaacgacgagaccttgcgcccgatgggacggcagaccactggcgtgcaaggcatgaggttccgctccggcgatgagctgttgagcatggacgtggtgcctgcggattccgacgacgatctgcttgtggtcactgaccagggctacgccaagcgcaccgccctgtccgagtaccgcctccagggacgcaacggctacggggtcaaggccctggccttggtcgagggccgtgggtccctgaccggcgcgttggtggtgagcgagaacgaccaagtcatggcgatcatgaagtcaggcaaggtgatccgctccgacgtcgccgaggtcaagcgcaccgggcgcaacacccagggtgtcaccctggccaagcccgataaaggcgacgaaatcatctcggtcgcccgcaacgccgaacatgacgacaatgacggcgatgatgatgaggcgggcggggccgacaccgctcagcagacaccggagaccgaacccgccgaggtctgatcagggcaggtccggcggtagtgtggaggagcggggccgccccccgctcctccagaggaagctggtagcctcactagagggtgaggggctcgtgggctccgaacgcagtggggtcgtcttggttgaaatgagcaaggagcaccgatgagccagaacaacagcggaaagtcccaaccaaagcagggtgtcgaccatcccgggcggtcggtctccggcgcagcccaggcatcccaacgaccgtcccaggccggtaagcccgagaccgcgcccaagagcgaaccggcccagcaggcgaaggcccaggccaccgccccggcgaggggccagactcccgtcaaggctcagcccgctgcgaaggaagccgggcaacaagacccacaggcgaagcaaacggccaccgtcaagggtcaaggccaggctcaagagacccagcgcaaggtggagtccaagtcccctgcgcaagcttccaagactgctcaggacaatcccgccaaagctgccaagcgcaagcaaggccagcaggcggccagcatgggcgcgactgtggcggccgcctccaaagacaagcccaaggtagaagccaagccggcagcggcggcggcgactttgaagccgattaaaccggagcaggtccgtcgggctggagcgcccaggaccgccgcttcctcctcctctgaatccatcccgcaggtcgccgccagtttgaaggggcggcaggagacttccgcccacccacgctcgtccgcctcccctacggccaggcccgcggcaaccgcccgtccagcggtctccccgcgtccggcggcctccacacgcacggcccgtcccaaccgacaggcttcggcggggatcggcggcggcgaggataaggtccgtgtgccgcgagcccggcgtatgcagctttcattgaccagggtcgagccctggtcggtggccaaggtctccttcctgctgggcatcgctggtggcatcatccaggtggtcgccacctccttgctatggttcctcctgaacgcgatcggcctgttcgacaacatcacccagatggtttccaagaccggtctggacgccggcggcctcgatttgagctccgtgctcagcctgggcaccgtgattagttcggtcacgattttctccattttcgagatcgtcttcatcgtggtcctggccacgattggcgccttcttgtacaacatcgtcggctccctggtcggcggcatccacgtgactttgggcgacgactagtttacggtcctgaacagccggcggccccttcgtatcgggggtgtgaaggcgccgccggctccgggctttaacctgcgcacatgctctcgtatcttggctctttttcagcttcgttcggcctgtccatcgcggtctggcccttcgtctccttgctgctgaccctgccggttttggctctgatttaccaccgctaccaccgcctgcgcttggccgcggccttggccgcctacctggtcatcctctacctgttggccctggtctgcttcaccttgtggcccatgcctgacgatcgcgccgccttctgtgccacccaccacctggctccccagctcaatccgctgcgcttcctgtccgacctgtccttcggcggccgtgacgctttgctgcaaatcgtgttgaacctggtgttcttcctgcctttgggcttcattatgggccgcgtcttccgctggcgcctgcgcctggccctgcccgcgggcttcctgacttccctgaccatagagaccgcccagctgaccggagctttcggcctagtgggctgcgcctaccggctcttcgacgtggatgacctcctgtggaacacctccggcgccctgattggctttgcctgcgcggtcctgctcaaccgcttggtcccgcctcgttcgacccatgccaacgaagtggtccgctcccccagtttccttcaccgttgcgtgacaatggccgtggatctggtcctggtctattccctctcctcctccttgggtttcggactggtggtcgtgatcaacgcttgggccggtcaccgttcgaacggcgactacgatttggctggctgggccgtctccactcacgccctgcggctcatggttatcgccctggacttggcaagcctgctcttcttcgagcttttgatcccctttctgcgccgggggcagaccttgggcgcggcgttcactcacatgagcgtggagacgcgggctcggcggggttggacgcgcgcggccttctacctggcccgtacaacggttctcctgcttgtcttcggcccttggagcggtcgtctgcgctcctgggtcaacctgctggccttccttcttctggtcttctatgtaatcaagcggcagatgccctatgacctcatccccgtttcacccgtttcaacggctgcgtcaccgctctcgcgtcccgttggcgggcaaggcagcgggtcagcggtcccccgctttgcctggtcttctgatgcggacttcggagacgacaatccccacgaagatgatcgcgaagccaaccaagtgggcggtcgtcaattcctcgcccaaggccaggacggagacggccatgccgaataggctctcggtgcacaggatcagtgagccttgcgcggccggcacttgtgagaatgcgacattttgcaggttctgggcgattagcgtggagaccagcaccaagtaggtcagagcgccaatcgtctgggggtgcagggtggccagttgcggcgctggctcggtcagggcggcgccgatgaggaagaggactccggccaccagcagttcgtaataggtcaggatggtcgcgtcgaaattcttggccaggctgccagccagtacgatgttcataccgtagcagaccgcaccggccagggtcagcaggtctcctgggcttagagccaggcgggccgagtcattcggtgacaaggagatgaggccaacgccgaccacgcacaggagcgcggccaagaaattgcgccaggcggggcgcttgcgggtggccgcccaaaccaggaagggcaccagtacgcagtatgtggcggtcaggaaggagttgcgccccgggccgatggtgcgcaagccttccatctgcagcaggaaggcggaccagtaggtgatccccagtgtcagtccgggaaccagcatgtccaacagatgggcccgccgtaacttgggccataggatcagggtcatcagggctaccgcgatcaccagccgcacgcccatgatccactgcacgctcatttggcgtagggctattttttcgaaggtgtatccggccccccaggcggcggccgctgccagaagcatgagtctggcggcccaagggttcaggtggatggagtcgtcgcgggaagtcatgccccaatcctagctgtgcccaggcccaggtttatgggcgttcgcttatctgggaattttaatctcaagcgtatagagaaaaacacaagaacttcacaaaagactgtccctagtttatactagtacttttaagcaaccaaggttcgcgttgaaccatgatggttgcttggttttccgcaatgcatgcggaagagagaaaggaatttgggcgaatgttcgcttttctgaaaccagcgcctcctgcggccaacaaggtgcccgcaggtaaggtggccggtaagtaccggcagtacaggatcagggtcttcctgagcatttacctcgggtatgccggttactacatcgtccgttcaaacttctcggtggcctctccctacctgaagaagaactacggcttcacgactgcggacattggtctgatcactctgtgcctagccgtttcctacggcatcagcaagttcgtcatgggcatgctctccgacaagtccaacccgcgtttctacatcgccaccggcctgctggcctcggccttcctgaacctgatcttcggcgcgacggccagcaagggcgtcatgatgttgctgatggtcctgatgggcatattccagggcatgggcgccccagcggctcacaagtccctatccaattggtgggcggagaaagagcgtggctccttcgtttccatgtggaacacctcccacaacctgggttccggcaccgtcgccccaatcgtcgggtttgcgcttgcggccttcggcccccacatgtggaagagcatcttcttcgtcccctcggtcatttcgatcatcatggccgtcctggtcatcgtgctcggcgccgacacccctgagtccgtgggcctgccgcccatccaggagttcaaggccgacgagtacaagggcgagaagatcgacaagtccaagctccagtcccactcggatctctcaatcccccagattttcatccgctatgtggcttccaacccctacatttgggtcttggccctgtcgaacgctttcgtctacatcgttcgctacggcgtgttgaactggattccgatttacctgaacgaggccaagggcttctcgctggcgcaagcccgctcctccttcgccctgttcgagtacgcggccatccccggcacgatcctgattggatggatgagcgataagttcttccacggcaagcgcgctggcatcgccgcggctcttatggccctcctgggtgtcatcttcttgggctactgggcctccagctccttgtgggccatcgacatcgagatcgcgctgatgggcatcttcgtctacggcccacagatgctgatcgccgccctgaccatcgatctggcacctcggttcgcaatcggcagcaccaccggcttcgtcggcctattcggctacatcttcggcgaggcgaccgcttcctatggaatcggtgctctcgtgggcaagaacggttgggacaaggggttcggaattatcgccatctccgcggtcctgggtatcgtctgcttcctgatcctgacccgcgccgagcgctacaagaaggtggaggcccccgaggctggcgtcgttgaggactgactgtcggctgctgattgggcaggtggcagcgcggctcaagcccgttcaccgcttactagtgaagtgcgtgaagcgataagcaagaagtgagaaaacatggtgggcggcatccgcaagggtgtcgcccaccgtcgtatgcgctcttctgggccggattggatgatcagtgaagtacaacgatagtggtcacctgtgggcgcataccctccctgagtggttgaacgtcgacggtgtcgttggcatataacccttgatttttctagctagttgtgcaatttacgaaactgttgtatattttcttcataagtacaaggttgtatgaaaaaagccaagaactaacgaagccattggtttgaccattagaacaacgttgtattaaatagcgtgctaactctagggaagggcatcatggcatctccattcgactcttcgattcaccaggctcagctggacgtggatcctgacttccgacttgcttcggttccagaccggattttcggttctttcgccgagcacctaggccgatgcatctacaccggcatatatgagcctggtcatcccaaagctgactgtaatgggtatcgcaccgatgtaatggagttggtccgagagctcggggttaccgccattcgctatccgggcgggaatttcgtctccggctaccgctggcaggatggcattggtcctcgcaatcagcgacctcggcgcctggacttggcctggcactccacggagaccaacgaattcggcttgcacgagatggtcgaatggctcaagcgattgggtggaaacgagctgatggaggctgtcaatctgggtacgcaaggtacgcaggaggcccttgatttgctggagtactccaatattccctccggtaccgtcctgtccgatttacgccgccgcaacggctccgaagacccgttcgatatccatatgtggtgtctgggcaacgaaatggacggcccctggcagctggggcatcgggatgctgccgactacgcccgcaccgcagccatggcggcggcggccatgcggcagatggatccggatgtcgagctggtggtttgcggctcctcaagccacagcatgcccactttcggcgattgggaacgcacggttttggaacgtacgtatgagcaggtggacttcatctccagtcatgcctactaccatccggtcgatggtgacatggattcgttcctggcgtccggtgaggatatgggggctttcatccgggaagtggctgcagtaatcgacgccacccgcgccaagctaaagagcgatcaccaggtggcgatttccttcgatgagtggaatgtgtggtaccaggacagcgagccttcgcgcacacctgaggggattggcaattggccgcaagccccgaggctccttgaagacgtctacagcctcgcagacgctgttgttttcggtgacttgttgattactttgctcaagcatgcggaccgggtgcgttcagcctccctggctcagttggtcaacgtcatcgcgccgatcatgactgaacctggaggccctgcatggcggcagaccactttttatcctttctcgtcaacggcgcgtctgtccaagggtggcaatgtcgtcgagtcacatatgaacagcgacttctacgagacggcccggtacggtgatgtgcccgacctggattcggtggccgtaagccaggatgacggctctctgtcgatcttcgtcgccaatcggtcgcgctctcggccgtatgacctgaccctgcgtctgcccgcgtgggcctgctccggttattcacggattgaggcccaaaccttgcacgacgatgacatccaggccagcaacactttggaagcgcaggatcgtgtcctgcctcacccgaacacgactgcccgcttaacggcctccggcagtcaggcctccatccacctgcccccggtttcatggagcgcgattcggctttctgggatgcaatgatgactgattgattgatgtgatcggtcaatcagaaagaagggaggaagcgcaaaacgaaacttcaagcgggttggtatgacagcttgcttcgagctcaattgtacgaaaaaggaaggtagaccaatgaagaaatcgatgaggattgcttcagcttgcgtcgcatgtttggcattgttgtcgttcagcgcctgtggcgcaccgggatcccaaggctccaaggacgccggaggggctgaccaggtgcatagcgacgccaaggcgaatgatgatgcgaagtgtcaaaacaccatcaagaaaaagggtgttgagaaggtcacggtttgggcctggtacccagccatggaaaagatggtcgatacatttaacgatcagcatgatgatgtgcaggtttgctggaccagagctggttcggggcagactcaatatcagaagatcaccaccgcagtcaaggcgaagtcaggtttggcggatgtggtgcaaatcgagtatgacgtgctgagccagtatgtatcaggcgtcgagaagcacttggtcgatctcaaccagtttggggccgacaagctttccgataagtacaccaaaggtgtttggaatgcggtgagcttgaggggcggtaagtctgtttatgcgattccagtagaccaaggcccatacgtcatgatgtatcgaaaggatattttcgataaatacggggtcaaggtgccgaccacctggcaggagtatgagcaagccgggaaagagttgcggcagaagggcttccaggggcatatcggcaactacgaacctagcggtaacggttctaacgtcacgcttatcgcccagaacaagggcaaagtatatgactactctgcctctcagcctgataagttgggcgtcgacttcactagcaaagagtccaaggaggtcatggagtactggcagagactcgccaaagagggtgtggtgaccaccgatgacgcttataccgccgagtggtacaagaagattgttgacggttcttgggctacggcggtttgcgcgtcctggctggtagggaatcttcgcggggtcagtggggcggattcgagcgctgactggaaggtagcgaaggctcctgggtggagttccacaacgccgagtgtgaacttcggcgggtcgtctttggctgtgaccgaccaagcgaaggttacgaaaaaggccgccaaggtagctatggagttcttcgatgatcctgccatccagcagacggctatcactgaaagcggactcttcccaacgtggaccaaagtcttgaattccgagagcttccagaatatgacggatcccttctacggtgatcaaaagataaatcaggttatagctccagtagccctagggtacaagggctatgacttcttgcccttccagccatacgcttacgacgagcagaccaaggtcttcaccgagattgtgcgcaatggagcggatgtccccagctcactgcgtgcattgaacaagacgctcactgactatgcaactcagcaagggttcacggtcaagaagtagcgcagaattggggccgggaggcctgttccttccggccccggttatgagaggcaacagtcatgtcatcaatcaggtcgaaagcgctccccgcgcgtaagcgagggatatccaggaaggaaaacgcctggggctggttctttacagcgcctttcgcggtgattttcctgttcttcctcgtcatcccactggcatacgctttttacgtttctctgttttcttatacgcagttgaaaggtgctgtgttcacaggcctgggcaactatacccgtgccttccgcgatcccattttcttggccggcatgggccgcgtggtcatgtatgcggtggtcatggtgcccacgcagctggtctttgcccttatcctggctttggtgcttgatagtgtaaagaaccgttttgcgtcgttctcacgcctggctttcttcttgccgtacgccattcctgtggtcattggggcactgatgtggggattcctgtactccaagcagatgggtccgtttacctccattttcgacttgtttggaatgaaggcgccggcattcttgagcccaagcgggatcttcgggtcgcttgtaaatatcgtgacctggcaatggactggttactacatggttattctgtattcggcccttcaatccgtaccgcctgaactctatgagtcggcgcggctcgacggggcttcagaggtgcagattgccttaaggatcaaaacccccatcatttcaagttcgctggttatggtaactgtcttctccttgattgggactttgcagttttacacagagccgatgattctgcgcaataacgtcccatcggtcatcgctccggaatacaccccgaatatgtacgctcaggcgctcgctttcaattacaaccagttaaattattccgcgacggtgtcgttcgctttggggcttttggtggtggtgttcagcgtcgttttcatgcgcttgacccggcatcagtcaggattggaggattgatatgggtaggcgaatttcacgcaatcaagttaccgatggcggccgcgtccgcagctctcaccgcttagcctatgtgctgctacttatctgctgcgtttacttcctgttccctgtctggtggctattagtggcagctaccaaaaacaacgccggcttgttctccggcgctcacggagctatgtggttcgacaataattttgcgttgtggagcaacatcaagcagctaagcacgtatgagggcggtatttactggcggtggctgttcaactccctcttatacgcggttgtcggtggtataggggccacagccatatcggtgatggctggctatggttttgccaagttccgcttccatggccggaagttctacttcaatgtcgtattgggcgcgctgatgatcccgacgaccgccttggttattcccacctttatcctgatgtcccagtttggcatgaccgacactatctgggcagttcttttgccttccctgctatctccgttcggcacctacctcatgaggatttactgcatgggctccttaccggatgaaatgatggaggcggcgagggtggatggtgctggcgaactcaggaccttcttccaggtttcgttgccaattatgacccccgctatcacaactgtcttcctgttgtcggtagtgggctgctggaacaacttcttcctgccatcggtcgtgctttctgacaccaagctcttcccgattacagtaggtttgactcagtggcaggtaaaatcgaatgctggtgcggggtcggagcaggtatggaacctgatcacgtcgggtgcgctggtatcggttataccgctcgttctggctttccttttccttcagcgatactgggtaggagggctggcggctggttccgtgaaggcctaatgggtaaaaccggcccacgtctgcagtgggccggtatacccttgttgtgaacggactcacccgcgatgctgaaggtaaaaaggtgatgaagcatgcaaaagcgagcgactatcaaagatgtggcgcgcgaagcgcatgtgtcgatcaaaactgtttcgaacgtcatcaatgattctggaagcatgaggccgcaaacccgaaaacgggtcgaacaggctatcgacagtctgggatattcgattaacatgtcggctcgcctgctgaaaaccggcgaatcacgtctcttgggtttggctacgttcgacttcgcccaaccattcccagcgactttcgttgacgcggtagtcaaggcagctcgtaaacgccagtacggggtcgtcgtcgatacatacgacagcgacggggaagggctgagcacgatccttaaagagattccccagcttggggcggatgggtgggttttcctaatggaccgaccggcccatcccaagtccatcctcgaccagaactatcctctggtattggctggtgattacctgtcctacgggaaagtggatagcgttatgatgcccaacgtcgatgcggtcaaagccgttgtgggaagattgctcgacggtggggtggaacgcataggccttatcggtgctcctgatggtgcggaccgccagcttgtcttcgaagcccaggaaggcgggcgtcccatgcgtacccgggggtatattgaggcttttgaagaacgcggaatgcgggtggattggcggattatggtgtccggcaataagtggatcagcagtgacggtgaacgggcggtgagtacgatgctagccaatgctgatctgcctgaggccatagtttgcctcaatgacgcgctcgcgtttgggaccatgcatgagttgcaacgccgaggttttagtatccctgaagatgtacagattgtaggttttgacaatgtggctgaagggcgctactccaacccagccctgacgactatcgaccccaataccggtgatttcgctcagcgtgccgtcgatatggtgatcgagcgtatagaaggctatcaggggccggccagaatgtgtaccactgattttcggcttatcgagcgcgcttctacttggttcgaacgctaataaaagcagatttccccccgcacgctttcagcaggccgccgaaccggtaatcgttccacacagcaggcagttattatcaaactatcagataccggtcggtgcaaggtcagccattaggctatcggggtccgagcccggccgcagcgagtgacgataagcatcgaggagggctgccccatgatgcgtgcgcatcgcctgtctgggcccagggacgaggacggccgtccgttgcctcactccaccagccgtatacacagggtcgccatcaatggcgcaaatctggccttttcgatgaatccagcccctcgccaggctccaatcctcctctacttgcacggcggtcccggcgatgcctgcatccctctgaccgagcgctacaacacgcccctggagcgctatttccgcgtcatcaacctggaccagcgcggctgtgggctctcctattaccccttccgcccgggtgagagcatcaccatcgagagcatggtggaggacatccacgctttcgtcgccctcctggcccgagcctatcctggcgcgcctatcaccctcttggggcactcttggggcagtgtcctgggcctggagttcgcccgccgctggccctctttgattcgccgtttcatcggcgttggccaggtggtctgcatgcctgccagtcaccacgcgcgttccctccccaccccgggcttcagcccggcctggctggggcggcttgtggcccaggagagcaatctggctgacctcctcttgctcttggttgagatgggccgcactggttggttgcgtggactgcgccaaagtctggaccgggtggccgcctacctgcggtccccggactacgggctggccggtttatggggattgctgctaggggcgcaccagtcgcatgcccgccttgattcgcagctggatagggtggatttctctgccatccgttcgttcactgcccctgtggcttttttggaggggcgtcacgaccagcacctgccctcccagctggtggctcgctatgccgccaggttgacaagtccgcacgaattcgtctggttcgaccactccggtcactgcccgcagtgggaggagccggggcgtttcaatagggaggtgctgcgtctgtgcagggaagactttaatgacgacacgccgtagaatggcggaataacgccgttttatgccctgtcaaaagggtacgatttgccataggagcttgttcgtagtaagtttatcacttgctgccgctcagctgcacagagtccacaggggttctttgcagaggggtgtgtaagagtggtttgagaactcaatagtgtgtttgtactgcttatagttttttgattgtcagtctgatgcctgcctggcgtgtttgcgttgggtgcgtgggagcgcttaattggtgtcgggtttttttgtgtgggccttccattggaccgtttggtttggtggttggcttttttgtcagttttgtattggggcttgtttctgccctttcattttttttgtggagggtttgattctggctcaggatgaacgctggcggcgtgcttaacacatgcaagtcgaacgggatccaagcagcttgctgtttggtgagagtggcgaacgggtgagtaatgcgtgactaacctgccctgtactttggaatagctcctggaaacgggtggtaatgccgaatgctccgcgctatcgcatggtggcgtgggaaagggtttctggtatgggatggggtcgcgtcctatcagcttgttggtggggtgatggcctaccaaggcttcgacgggtagccggcctgagagggtgaccggccacattgggactgagatacggcccagactcctacgggaggcagcagtggggaatattgcacaatgggcgcaagcctgatgcagcgacgccgcgtgcgggatgacggccttcgggttgtaaaccgcttttagcagggagcaagccttcgggtgagtgtacttgttgaataagcgccggctaactacgtgccagcagccgcggtaatacgtagggcgcaagcgttatccggatttattgggcgtaaagggctcgtaggcggtttgtcgcgtctggtgtgaaagtccactgcttaacggtggatcggcgccgggtacgggcaggctggagtgcggcaggggagactggaattcccggtgtaacggtggaatgtgtagatatcgggaagaacaccgatggcgaaggcaggtctctgggccgtcactgacgctgaggagcgaaagcgtggggagcgaacaggattagataccctggtagtccacgccgtaaacggtggatgctggatgtggggcccgttccgcgggttccgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcccgacggtcgcggagacgcggcttcccttcggggcgggttcacaggtggtgcatggtcgtcgtcagctcgtgtcgtgagatgttgggttaagtcccgcaacgagcgcaaccctcgcctcgtgttgccagcgggtagtgccgggaactcacgagggaccgccggggttaacccggaggaaggtggggatgacgtcagatcatcatgccccttacgtccagggcttcacgcatgctacaatggccggtacagcgggatgcgacatggcgacatggagcggatccctgaaaaccggtctcagttcggatcggagcctgcaacccggctccgtgaaggcggagtcgctagtaatcgcggatcagcaacgccgcggtgaatgcgttcccgggccttgtacacaccgcccgtcaagtcatgaaagtgggtagcgcccgaagccggtggcccaaccagttcgctggggggagccgtctaaggtgggacccgtgattgggactaagtcgtaacaaggtagccgtaccggaaggtgcggctggatcacctcctttctacggagatttcttggaatcctcgcgttgtttgacgtggggtcgtggccctggcggccgccgttgggcgggcgcgcgtgggctgttccactggtgcggaagcgatcatcgctgtgggtggtatgggcatgctgttgggttcccgggccgctgttcgcggcgcctgggcgccatccatggctggctggcccttcgtgggtcgtgtcggcggtggcgtggtggtggcttgagaactggatagtggacgcgagcgatcatggctggccgttggctggtcgtggttgctgcatgtttttcgccgggcctctgttgttcaggggtctggttgatcgtttgatgtgtttttgtgatcttgattgtgttgatgtgtcgtctggtaggctgtgcgccgcgtcgtggtcccgggggttcgcccttgggggtcgcgtcgttggtaagggcgtatggtggatgccttggcagacaggaccgatgaagggcgtatggggctgcgataagcctcggggagccgccgacagggctttgatccgaggatttccgaatggggtaacccgccggccgtcatgggccggcaccgtttttgaacggggggtacgcagggaagtgaaacatctcagtacctgcaggaagagatattccgtgagtagtggcgagcgaaagcggatgatggctaaacctttgccgtgtgatacccgtcgggggttgcggtaggggtgttgtgggacgttccgtccaggggccggcgaccctgggggcagtgataaagccgcgtgtgaggcgaacaggattgaatgcctggccgtagagggtgatggccccgtagccgtcagcgcgtggcctgcttgtgggcgctcccgagtagcgcgggactcgtggaatcccgtgtgaatccgcaccgaccgtggtgtaagcctgaatatgcctgtctgaccgatagcgaacgagtaccgtgagggaaaggtgaaaagcaccccgggaggggagtgaaatagtttctgaaaccgtgcgcttacaatccgtcggagcctggggtttgccctgggtgacggcgtgcctatcgaaaaatgagtctgcgagtcagtggtgcgtggcgaggctaacccgtgtggggcagccgtagcgaaagcgagtctgaaaaggcgtttttcagtcgcgcgccctggacccgaagcgggatgatctagccctgagcaggttgaagcgcgggtaaggccgcgtggaggaccgaacccacttaggttgaaaactgaggggatgacttggggttaggggtgaaaggccaatcaaattccgtgatagctggttctctccgaaatgcattttggtgcagcgtcgcgtgagtgtctgccgggggtagagctaccggatgcctgagggcccttgctgggtaccgagggcagccgaactccgaataccggtcaggtgtatcgcggcagtgagtcggcgggggataagctccgtcgtcgaaagggagacagcccagatcgtcgtttaaggtccctaagcgcgtgctaagtgggaaaggatgtggagtcgcatagacagccaggaggttggctcagaagcagccatccttgaaagagtgcgtaacagctcactggtctagtggctccgcgccgacaatgtagcggggcttaagcacgccaccgaagacgcggcagcgcgttcgtcgcgctgggtaggagagcgttccgcggggggtgaagcggccgggtgaccgggccgtggaccgcgcggaagcgagaatgcagacatgagtagcgagaggcgggttggaatcccgcccgctggatgaccaagggttccagggcaacgttcgtcgtccctgggtgagtcgggtcctaaggcgaggccgacaggcgtagtcgaatggatgaacgagttgatagtctcgtaccggcgtgagcgcgtcaggcttgaaccgtcgatgctgtgtccttcatcggccgggcggccgctttcgggcggttcgccgggttggtggttcatggcgggggcggggatggcagcgcgggagcgacgcgatgggatagccgggccgcggcggtggtagtccgtggttaagcgtgtggcgcgccaggcaggcaaatccgcctggcatgagcgtgaggcgtgatgatggggggtcttgtgccccgaatccggtgtgtcctgtcgcctagaaaacctccggcgtgagttctcatgccgcccgtacccgaaaccgacacaggtggtcaggtagagcataccaaagcgatcgagcgaatcctggtcaaggaactcggcaaattgctcccgtgccttcggcataagggaggccccgggcggtgaagagacttgctctcggagcggtttggggcggcacaggccagggggtagcgactgtttaccaaaaacacaggtgcatgcgaaggcgtaagccgctgtatatgcactgacgcctgcccggtgccggaaggttaagaggatccgtcagcccgttcgcgggcgaagcggtgaattcaagccccggtaaacggcggtggtaactataaccatcctaaggtagcgaaattccttgtcgggtaagttccgacctgcacgaatggcgtaacgacttccccactgtctcgaccaggagctcggcgaaattgcagtacgagtaaagatgctcgttaagcgcagaaggacgaaaagaccccgggacctttactataccttggtattggcgttaggcaacgactgtgtaggataggcgggaggcttcgaagcatgggcgccagcccgtgtggagccgtgatgtgaaataccgctctgttgttgtctggcttctaacctcggccagtgatcctggtcagggacagtgcctggcgggtagtttaactggggcggttgcctcctaaagagtaacggaggcgctcaatggttccctcagcccggttggcaatcgggtttcgagtgtaatcgcacaagggagcttgactgcgagagcgacggctcgagcagggacgaaagtcggagatagtgatccggtgccggcgcacgggcgcggcatcgctcaacggataaaaggtaccccggggataacaggctgatcattcccaagagtccatatcgacgggatggtttggcacctcgatgtcggctcgtcgcatcctggggctggagcaggtcccaagggttcggccgttcgccgattaaagcggcacgcgagctgggttcagaacgtcgtgagacagtttggtctctatcctctgcgctcgttggaatcttgaggagacctgcccatagtacgagaggacctgggtggacgaacctctggtatgccggttgtcacgccagtggcacggccggttggctacgttcggatgggataaccgctgaaagcatctaagcgggaagccccctccaagataaggattccatgcgccttcgaggcgcgggaggccccacgcagaacacgtggttgataggccggaggtggacaccccgtaaggggcggagccgaccggtactaacggccgatgacgacacgatcacgcccttgccgtgtggtgggggtcgtggcgtggcgtgagcttgccgtgacggacggccttcaacgggtcagggtccggcgcttcaagcgatcatgaggaacacgcgtccgctagccggtccccgagccagcaccaagcatccccgtcaacgcgggggtggttcatggattgttgtttgttttgcggtggtcatagcctgggggagacgcccggtcccattccgaacccggaagctaagacccagcacggcgatggtactgcactcggtagggtgtgggagagtagcgcaccgccgcaacacaaacgttcgagagccccggcaagcaccacgcttcccggggctttttgcatatccagccgatgccgattctttcttctcaatcagtggaatccaggttgcgatcttcatatagcgccgccataggtgtaccttctcatgtgcttctaggttagaacattgtgctgaagcagggtatgtcaatggttgagttgatgcccttataattaggcaattgcgaatcggacactgactcgcttttttctattttggttagacttcccagccatgtgtgaagccggcacttgttaacagtaagtaactgacccgtatcaacgaattctatcattaatgacaccaagaagagtctacctgtagggtaaatcagcattagcactacatttattgtttacagcacagtactgagcaagtgttaaacgaatctgcaactataagatgaaacgttaccaagatggtagttagccatgtttcttgactaccgattctctgaaggggattttcgacttttcatccttgtgacgttttctggcatggcgcgtatacgcattgtttaagccgcatgaagaactaagaaatacgagggcagctttccttttgtaccgttgccatatccagtagtttatgtacagatcttcttcgctccctgctcggagtaaacgccaggtcctaacatgcttggcaaaatactcatctgtgtatttgccttttcttacaaagtcgtacaagtagccgagcggaaaaatgataatgagaatgataatgaggagacacaaaaaaacaagaactctggccaaccattgatttaacaaagacttcgcttcctctgctaagaccgggttgatatggacgggaaagtcgaattcggtgtcagttgacaatgatacggttaaattgtggtaggcagatgtgattgccgttatgcacatgcaaaaatcctttcggcaaaaattgaagttccacagaatagtacaaaatgttgaaactcacgctcaagaggatctgcctggcgtgtctagcacgagagtattaaaagcggttagaagagtgtggattagctggcagggcagcgtttaggcgcacaaaggagataggtatgaacatcatagtcgtaggagccagcggtcgggttggtcgggcgtgtgtgcggcggctggaggcgcaagggcggcacgttatcgcctgcgccaggcatttggacggcatagaggccagtgaactggtgacgccggtcgcgtttgatatggccgcgccgctgaatgccatgatcacggtatttaaggacgcacaggccgatgccatcatctttacggctggatcgcgcggggcggacgtcattcatgtggacgctctgggggctatcaagacgatggaagcggccaagggggccggcatcaagcgctatgtgctgctgggggcgctgtttgcggcggaactggagcgttgggacgagcctgaggtcaagcgggccatcgaccagctgccggactattacccggccaagtactttgcggacgaccatctgatgcactccgggctggactacacgattgtggagccgggggcgctggtggaagaggccaggacgggcgcggtcaacgtggatgggcggcagaccgggcccatagccatcgaggatgtggcggccatgctggtggacagtctggggcagctgggcagcgtggggcgggtgtaccagatcatccagggggacacgcctatcgcgcaggccctgcagtaaggacgcggctggggctgggtgcggctccgccgtttcgacgcgctggtgtggtgagcgtaactcggtgggctgtcggcccgaggcgggtatatatataccgacgggcgcgctaccgattggcggtatgtgtggcggataaggggagagggccagcggacacggatgtgcctgctggccctctcgctatgacgggcgggtgcttaccttcagcggaccgcggtgagctggccttcgctcagggtcagtagctggctggcgtgggccagaactgacgggcggtgggagacgatcagataggtcttgcctgctttactggacaagagcgcttcgatgacccttccctccagcagggcgtccatgttcgaggtcggctcatccatcgctacgaacggggcttggctgagaaaagcgcgtgccagagcgacccgttgcttctgcccctctgacagctcggccccgttgcgcgccaggatgtggtccaggccgttgggaagctggtcgatgacatcgtccagacaggcctggcgagcagcatccgcaatctgctcgcggctggcatctgaacgcgctatggcgatgttgtccgccatggacacggagaagatgaaggtctcctggctggccaaggtctccaggccgcgcaggctggaggtgcgcacgtcctcgattgggcgatcgcacacctccagacgaccgccggtgcgctcacggaagcgcatgagcaggtctatcagggtggacttgccggagccgttcgccccttggatgcccacgattgatccaggctggatgctcaggttgacgccgtccaagaccggcttggagccggaacctgaagcataggagaacgacaggttgttggcttggataccggagaagcgctcaacctcggttccatcttcattctcaacgactgcaggccgctcgtccaacagggagaagacacggcgggcggcggcgagtgtgggctgcaagccagagcccaggttcgagatcgcggctacaggggcgaaggaggagacgaaaccgatgaaagagacaatagcgcctatgaaaccgatgtggccggtgagaaccagaatccaagccaggcaagcgacaccggagaaggcgatcaggcaggccgtcatcgtgaaaatcttattccagccggtgttgaactgggtgtcgcttcgggcctggagcatggtgtctgtggcttcagcaagcctttgacgtgtccgagccgctgccccgaggccgaagagctcccggcgtccgtcgagcgtctccaaaagcatggaatggaggtctccttcggcgttgcgctcaatcagggccgagcggaaggcggtgcgggcggtcatcagcgggagagcgaggccgatgatcaggtagcaaagcagggcggccagggctatctgcggcgacaggcaagccaggacgatgacgttgaccacggaggtgatgatggcgatggcgacaggggatagggtgtgcgcgtagaaaatctccaggagctcgatgtcgtcggtgatcaggctgaccaaatcgccgcggccacgctccttgagcttagtcggggccagggcgcgcatggcgtcgaagaccctgccgcgaaggtcgcgcaaggcgctgaaggccatctgatggttatagagctgctcaccgtaagccagggggcctcgcagcagggcaaggacaatcgctgtgaccgccagtatctgccagtggccgatcagggatttgcccccgatgaagaagccgatgatggccgcgcttgcgcacatgatggcccatacagcgcacaagtgtctcaaggtcccgcagatgatggccctgagctcaatcgggaggaggggccgcatgagcttggtcatgcgtcgcatcgtcccgattgcaccctgggatcgatcaccggcgtgggaagcccgcttggactgacccgtatggccggcggtttcggcgtaagcggcagcgtggccatcagggttactgggattgccgtccatgctggtgctggcggcgcttaaacggctgtcagttggagcctgaccggctggcgcgccctgcgaggcgagttccggcacctgaaggctcagattgtaggatgacagggggttggccaccgctcgcgattcctcttcggtcaacccttcgaggcggttctgctccttccactggtcggcgaacaggccgttctggatggtgagctcatagaaatcgccggactgcgcgattcggccttcatccagcatcaggatgcggtccgcctggcgcacacccgccagacggtgggtgattgtgatgaccaggtggtcgcgtcccagctcgtccatcaggcttgccaaggcttcgtcatgatcgcggtcgacagcgctggtcgcttcgtcgaaaatgtaaatcggggtacggcgcaggagggctcgggcaatagccagacgctgccgctgtccgccggataggttggcacccgcctgttcgactggcgcatccaaaccactgcgagcggttgctaaatccgcgagatcggcccgcttgagcgcatcggtcagctgctcgtccgtgtagccgctggcagccggatccagattggtgcggattgtgccactgaaaaggtggtcgttgccggcggccatggtttccagggcgataaggcggtcctgaggcaggctggacagttcctcgccgtcgatggtgatggaaccctcgtaacctgtcagacggcctgagagcaggccagccagggtgctcttgccggaaccggaggcgccagccagaccgaaatgaccatgggcaggcaggtcgaaggacaggtcgtgcagggctttgaacccatctggatatgcgtaggagaggcctttcacacatatgccgctggttagttgaactggaaccgtggccttatcactggcctgggtgtctgcggacttggcgtcctcggccgtggcatccttggctcggttcggagcgcccgcccggagcgcccgagcagccgcgatggccttgccctgccgcatcgcaacggtggcggagtgagtcaagtacaccagctgccgttccggagtgaaaaggcggacgccgacagccgcgacagcaatcgagcatatgaggcccgtcgggctggagcgctccatgaacgcggccgtgaggctggccaagatgaccgccaggcagatgaccgcatcggagctgaccagactgcgcagctgccctgccaggagctgcatggtggccttgcggaagccttcggagtcctcgctcaaacgtttggcctcgtcgccgtccgtcgcgaagaccttcaaagtccccagaccgcgcagagcttcctcaaagcgcactccaacgcgctcgtaacgtttgaggtgggtcacttgggcagcgatgttcttctgtcgggccatgcttgccgcgaagggcatcaccgccatgcctgcaatcacaatcaggccggctgcccagttgatcggcaggagaaccagggcggcaaccaggatcatcaagccggattgaatcaaggtgggcaggaagctggtgaaatacgagcttaccgacctgacgccctcggtggagagcgccgccatgctctggctgggcggcgtgcgtagttccttgccggcttggtctcgttccgtggtctccgggttgaacaaggagaggtagaggtcggaggaaagcgcggcgttcatgccgtcgcccagcttaatcgagctctggttagcgattatggcgcacaggcacttgaccgcggccaggaccatcagccaaatgatggcggcgagggggtcggagatgaacgaggcggtccaggccggagcaaccaggccgaagagccgtccgagggcgaaaatggcaagtggcagcatcagggtctcagccagggccccgatagtctggagcccgccgatgatggtggatcgacgcaagtcagcgccgggaagattcaagagttctttactgatcatgtctcataccctagtcgtaggagaatcgaagtgactgcttgcgaccctagcaaaatagcggcctatggacaagataagagtaagaatcacgctgatggggcgcgctcgcgaccctctgcggggtctggagcgcgtcatgggcggcacggtcaaagcggttgccgggcttcgggacctcgtcggggctgcatcaggataggccgtcggcgctggcggggttgtgccggatgcagtcctcgcgcatgaagcgatcgaggtcgttgaagtcctagttgtcgaaaacctgctggcggaacccgctggccgcggccttatcgattgcacgatgcggtgctcacgtcacgctctttccacgctggctgtgcgcagtaggctagtgcccgcatcccacggcctgctggtgccgttcttaagccagtccggccagccggcgctcagccctcggcaagggatttgtctagggacgcggcgtagcggcgctcgtcgttcatggtggcgaagttgagaccgataaggatgccgccgccgacgaaattgccgagcatggcgaccgctaccacaccgatggcctgccaggcgttgaccgcgccgtaggtgcctaaaatcaggaagagggcggagtcggcgaccgagtgttcgaagccgcagaaggcgaagacgaagaccgccaccaccatgatcgtgcacttggtgaaatcattggtgagtttgccgttatagaccatgagcatggcgatgttgatgcagaaattgcacaggatgccgcgcacaaaaaggtccgcgaccccctgccagccgcccgtgatgtagccggtcttggtggctgacgccgctagcatttgcgccattgtcgggccggagatgatcgtcgagcagcgcaggatgagcgcgatgagcagggcgccagccaggttgcccagcaggcacaggcccaggatgcgtaaggagtgcagccagcctaggcgcttgtggtagacgccgatcgtgacgaccatcatgttcgaggtgagcagctccgagttggtgtagtaaatcagcaccagggcccagccgaaggtgagcgcggctaggacgcggcccgccagcttgagtccggggttggcgggataggcggagaactggccgatgatgtagaagaaggcggtgaagaagatgccgacgaacaggccggccatgaccgcccgctgcaagtacttgctggtcatccggccggtcatcgtgtccttgctgtccgcgacgtccagcacggtggagatgaaggtgcgcccggggaagaggggctggggggccgcctggtccgcatctgtggatgttgcgcctggggttctgccgggggtcgcacccggcttggaagggtccgacggctcgccttcattgatgctttgatacagttcttcgctcaccatccaattatggcatcgcgaagacgccggacggcgggaagagcgggctgatgtgcgcgaagtcacgtttatttgtgcgcgctcgcgctcgctggctattagtgggctggccgactagcaggttgccggtgctcggcaaggggtcgccggatgagcctggctcgcccgcccaccatgcgtcgcagccgtccctaccgcttcgattatcgggcttcgttcttgtgcgaaggctcagggatgagcgtatccaggtcgatagagagggcttcggccaggctcagcaggttgcgcaagctggggttgctgggctgcccgctgcggttggccccggattccagccgttggcactgtgagcgactcagaccagccgctgcagcaagctcctcctggctgagcccgcgctcggcgcgcaagcggcgaaggttccgtccaaagtccagtgcatacgccgcccattcctcatcagtgaatagctgtcgtggcatacctccaccctaccccaacagtcgacgagtttattggatgccgggggcttctcaagatgggattggcacacgattggacaaatcgaaagtcagtgatggcggtcattagacagaagtcacagcctgggaaacagatatacatcggtgaacagccatctacggctcaaggatagccctggacgattcccgaaagtggagctgaggagactcgaactcctgaccctctgcttgcaaagcagatgcgctaccagctgcgccacagccccaaaatatgtggatttaactatcgcggcccattaagaatccgctgcgtgggcctgggaggacttgaacctccgacctcatccttatcagggatgcgctctaaccagctgagctacaggcccaaaccgtgtggtaagcaatcacacaagcagacagattatcatatggacgcagaaagtcaatttgcctcggcgatgcgagtgtttcgtggattggcgaaatcagcgggtcgggggagaatagggccatgcctcttactcctgatcaaagtcggcccaggcgagggggccgtggcgagttctcccgccggtggatcgatgtggacggccagcgggcgctgctgattcgcaagcgagtgaagaacgtctacttgcgcgttaaaccgccggaggggcggattgaagtgaccgcgccggcccgcctgcctgaggctgaaatccgacggttcgttagttcccggatggcttgggtggaaggggcgcgcgagcggatcgcgcgttcgcggcgggcgcttggtggcggttcgggtgccgtggccagccgtgctgaaggttcggaaagggagaggcctgccgcccggggtgagcatgacgagcaggagcggctgcggcaggcgcgcgggatcctgtccggccagttgcccggtctgctggacaggtgggtgcccgtggtgggtcgggggcccacgtcgatcaccctgcggagaatgacgactcgctggggctcatgtacgccggctagcgggcggattcggctgaatctggaactcgcatggctggagccccggtttctggagtatgtcctggtccatgagctgacacacctgcgggcatcggggcatggggctcggttccaagggctgatggactcctacttgcctggatggcgggaggtgcggcgggagctcaaccggtatgtcatcgtctgagacggccgcaggctgtggatatatgttgataattatgtggataagtggcacgttcgaccacagttctcatgaagctgacgctggtggtaagggcggggtatcttgtggaataaggtaatacatagggcgatgagtaggttggacggttggctggcccggggttgcgtctggcggctgccactggaaggagacgggatgacgaaccagagtaaggatgtgaagcgggcggttgtgaccggcgcttccagcgggatcggggccgcttcggcccgggccctggtggcggctggctggcaggtcgtgggcctggcccggcgagaggaccgtctcaaggagctgtctgacgagctggccggtgctttctcctaccgggtgtgcgacgtgaccgatgaggcctccactcaggcggctgtggagggaatcctcggggcggggccggttaaagcgctggtcaactgcgccggcggagcgattggcaaggaccctgtggccgcttccaaccttgatgactggcggtccatgtacgagctcaacgtgctgggcactctgcggattacccaaaagcttttgccggcgctgaaggaagctgagggcacggtcctggtcatttcctcgaccgctggcatcgagccttatgagggcggcggtggctattgcgccgccaaggcggctgagcgcgtcatggctcgaatcctgcgcttggagttgattggacagccggttcgggtgatagacatcgctccgggcatggttcacaccgacgagttcgctgtcaaacgcttcggtggagaccaggccaaggcccaggccgtctacgctggcgtgcctgaccctctgacagcagaagacgtagctggctgcgttcagtgggctttggaccagcctgacaccgtggatatcgaccaaatcgtggtccgccctcgggccgagggctcctacaccaaggtttaccgccaggggtcttaatcgggccggggtgattcctcggccggctgcgcgagggctgaaagcgagcgggggccgcgggccttccgcggcctgcggcccccgctagagaaaagggcgcttacgcactcaaggtttgctgtatcgaatcagatcagatggctgcgcatgaaccactggaagtgctcaagctcctgcacgtggtcctggacgatgttcgaggaaatcacatccaggtcgtcgagctgcttgatggcttcgcggtcagccttgatgaactcgctgtagtaggcgtccatggccttcaggtagtccagggcctcctggcggccagcgaggtccaggcccttccaggtgcggttcttaatgatgtcgtcgggacgtccatccgcttggccgcccagagtggcgatgcgctcggctgtctcgtcggccatagccagcaccgagtcgacctccgggtccatcatttcgtggatgccaatgaagttcttccccttcatgttccagtgagcgtgcttgagcagcagagcgcattcctgctcattgctcaggcggctctgcaagattgcaacgattttctcgcaggtggctgcgtcgagcccgggaacggtgaattccaatgccatgattactcctttgtccgctgtctgccggatcgattccggtctggcttttgcacctgacagctaatcggccaaggttgggctcggccttacttctagagtagatgacctgtgtaggaagtcaacctcatgaggcctgcgacttgtgtgattcgccagacgattcggtgcgcgctcagcgctcaggattccgctggccgctggccgctgcctctatcggtccttgtcagccttgccgctggcgccgcccgcttcgctcgcgttgcctgccttaccggccgctgattccgcctggtcgtcgtcaggcgcctcgctcccaccgtctttctcgccctttccctctccttcgcgtttgcgcacttggacggtttcgatccgccggccatccatgctggccacgatcatgtcgtagccgtcgtcggagcgcaggacatcgcctggctcacccagcttgccggtgtgggcctggaagtagccagccaccgtctcgtagggtccgtcctcaagctcaatgccggtcaggtcagcgaaatcctcgattgtcatgcctccttccactgtggccacgccgcccacgaaagcggtgcgattgggcctgggaccgcctttctcctccggcaggtcgtattcgtcgcggatgtcgcccaccagctcctcagtcatatcctccaaagtgacgatgccgtcggtgccgccgtattcgtcgatgaccacggccaaatggatgccccgcttgcgtagcttctccaggctgggcaggagcttggaggtgccaggcagggagatgccagggcgggtcacgtcggctacggtcttcgcctgggggtcgcgcacgtccagcaggtcgcgcacgtggacgaaaccgagcacgtcatcgaagtcccggccggtcaccgggtagcgggaatacggctccttgcgcacgaatgcggcggcctcgcgcaggctcatgtcagcgctgatgaagaccacgtcggcccgaggacgcattacttcggccacggaggtctcggaggcgtcgaacacgtcgcctaggatgatccgctcgtccttgctgaggttcgtgttggacgaaaccaggacgcgcagctcgtcgtcggagacctcggtgtcggtctgctgtgggtcgaagcccaagaggcggaccaggccgttggtgttcttggcgatcagccagatgagcggcttgcaaacggtggagaacacgtcgatggccggcaccacggcccgcgcgatctgttcgccgcgctgcatggcgatgcgcttgggcaccagctcggagatgacgatcgagaagtaagagatgatcagggtcagcacaattgtcgtcagcgtcgaagccaggctggcgggcaccccccaggagcgcaccagcggaatcaccgaaggcgcaatcgaagaggcgccgaaggaagccgaaaggaagccggaaagggtcacacctatctgcacggtggacaggaaggtgttggggtcacgggcgattttcgccacgcgcgcgccccgcgcatcctcctgctccatctgatccagctgcgagccgcgcaaagagaccagcgccagttcagtgcccgaaaagatggacccaatcagcagaaagacgaaaaccaacaggatgttcagccagagtgccatgccttctaatttacgatgtcagcgagataagcgccgtcccaggctgcggagaccggaggagggcatggtggggatttgtgcgtaaggccacactctcggatgctcgggggtcttatgttgcgcggaggcgacgggtagcatggggagcgcatggctccgggcgttggagcgggtagcgctgcttggcagcgtttccgcgcggcggccaggcttgtatgatgcaacatgcgccgcagtcggtgcgcatgccactccgcacgacgacaaagaggtaatgatgaccctactgcaacatgagctgaccgagttcaagacccaggccttccaggacaataaattccatgaggtgagcaagcaggacctgctgggacactggtccctcctcttcttctatccggcggactttacgttcgtctgccccaccgagctggaggacctggccacccgctatggggacttccaaaaggtcggttgcgagatttactcagtttcctgcgacactgagttcgtccacaaggcctggcacgaggccaatgagaagatcaacaagattcagttcccgatgctggccgatccgaccgccacgttggcgcgcgacctggacacttacaacgagtccgagggcaaggctgagcgcggcgacttcatcctgagccccgagggcaaggtcgtggcctacgaggtcatctcctccaacgtgggccgcaacgccgacgagatcctgcgccgtgtgcaggcctcccagttcgtttacgagcatggcgatcaggtctgcccggccaagtgggagccaggcgaggagaccatcgagcccagtctggacctggtcggccagctctgagcgccgccaggtggggccagcttccaatggccccgccattgggcccccgcctcaaggattgtggcgggggcccaagctttctcccggacggtaagcggctggcccagtgaacgtttcgcctgccgtccatccaggagttgggccagtttgaaagacgcggcctgtaggccctgtgcctgagcacacaagatcaatgcaaccactatgcgacaagacgcatgaggaagcactacgtggagggaacggtatttccgtgaaccaagaggatttgtacgatgcggtgatcattggcgggggtcctgcggggctggcggctgggctctacctggcccgcgctcgctaccggacgctgattttggagaaaggcgatttcggtgggcagatcaccattaccgctgaggtggtcaactatccaggcgtggctaacacggatggccgccagctgaccgagaccatgcgccagcaggctcagcgtttcggggcagagttcatgagcgccgaagccaccggcctggatgtggatggcgatgtgaagaccgtgcacaccacgagaggggacattaagactttcggcatcctgatcgccaccggagccaccccgcgcaagcttggcttcgctggcgaggaggagtacgccggcaggggcgtggcctactgcgccacctgcgacggcgaattcttctccgggcgtgaggtgctggtggtaggcggcgggttcgcggccgccgaggagtctgtcttcctgaccaagtacgcctccaaggtcacgctcctggtgcgggagccggacttcacctgcgacgcggctgtggccgcggacgccaaggccaatcccggcatcgagattcgctacaataccgaacttcttggcgtctccgcaggcaagggcggtttggtggaagccaggattaaggacaataagaccgggcaggagtccacttggacggccgctgacggcggatccttcggcgtgttcgtcttcgcgggctatgtgccgcagaccagcctggtccgaggcgtggtcgagctggaccaacgcgactacatcgtcacccacggcaaccttgagacctcggtgcctggcgtctacgcggccggcgacttgcgcgaaaagaacttgcgccaggtgattaccgccaccgccgacggtgctgtggccgccgtggagatggagcgttacgcctccgagatgtcggaaaagaccggtctgctgccaccgcgcccgaacgattccccctacgagaaggaagaggcggccgccgccagaagcgcttccgaagaaggcacctcgccggcgccagccgcatccggcaaggtcagtgagggcaaggcatccggcttctttaacgacgcgattcgtcagcaactggcggtggttttcggcaagatgggccagccgctcacactggagctgaccttggattcgacggatttgtccaaggagctggagggcttcatcggcgagctggtggccttatcgagcggcaagctggacagccgtgtggctgagcgctccgatgcctcttacgaccctgcggccgacatgcccctggctcggccctacgtggagatttgccggcggagcgctacgggcgacccggttcacagcggtttaggcttccacggggtcccctccggccatgagttcaactccttcgtgctggccctctacaatgtggcgggccccggccagtccttggacgcggacacccaggcgcgcatcgaggccatcagcgcccctatcgacgtgatgctcctggtctccctgacctgcacgatgtgccccacgaccgtgctctcttcccagcgtatagcctccgacaacccgaaggtgcgcgcccaggcctacgacgtggcccgcttccccgagctcaaggaccagtacggtgtgatgagcgtgccctgcattgtggtcaacaatggcggtgagcagatcgttgaattcggcaagaaatccgtccctgagatgctcgatttgatcggcgcctgaacgcgctcctctcgcgcggtaccgatgattagccgtgcggccgaacttggtcctgtttgacgtcatgctgccggggatgggcggttcaacggtgtcctcaccgtcctccctggcggttcagcagccgcaggattgacggatgaccagctcggcgtcgaccagttgcacgtcgggggtggagtccggatacaaggccgcccgcatggcgcgttccgcgatgccgcgcgtgttctgctgcatggttgtcagctgcggccaggtgtagagcgagtccacggttccgtcaaaggatacgatcgccacgtcttgcggtatgcgcagcccgcgttcgtgcagggcccgcagcgcgcccatggcctccaggtccgaggcggcgaaaatcgcggtgggtggttccggctcgtccaggagcgcgagtgtggcctggtagccgccttcacgcgaatagaaggactgcatgacggtgccagcgcgcaggttggcgtccaggtgcgcctcataccagccttggatgcgcatgtcggtggagtccttgggcgagccgccgaagagcatgtcaatacgccggtggccatgctcaatcaggtggccgacagcctggtaggcggaatcgtagaaattggtggatacgcatttggcccccgggaccggtctgggctggtccatgaacacgaaccgcgactggttcaggtgcgcgccggtgagttgggagtaatcgcgggtggatgacatgaaaatcgcgtccatgttgcgttccaccagcttgccgatggcgttgtcctccatgccggtgtcgctgcgcacgttcatgtacaccagcgagtatcctcgcgccatggcggcggtctgcagctcatcgtagacgccggcactgtaggggttggaggagtccggcaccaccacgcccatcatttttgagaagccggtccgtagcgcccgcgccgttgtgttggggtggtagttgagcatctgggcggccttgcgcaccttctcggctgtctccggcgccacgtgcctggggccgttgttgaatacatagctgaccacggcggtcgaaacctcggcgaggcgagccacatccgtcctggtggcccgcttgggccgcggctgcctggctcctgtttgcgctgtcatggccttcgcctccgtcgtccgccgcctgcggtgaacccgccccagcaatatctccatgctacccgaatactatagtctacacgagtagacaatagtcacgcgacaccgcgctttgcgggaaagactgatctctgagtaagcatgaacatgcagacaaatcccggaaaatagcggtgcaagaagttcatattgagtgtgtcattgatgttttttccctataaaccgtatgaatcttggcatccaagaccgtactttgacagacgaatctacacgtgtatactatatgtaccgctacggagcagccgtgggggagataaggctctggctgcgtcgcggcgagagacatccctacgaaggagtggtagatgaacaagttgaagtatgtcgcagccgctgtatgctgcacgctcgcagtgggttcgctggccgcctgtgggtcctcgtcctctggcgggaagcagacggtcgaattcatgaccatgcagtccaccggcacgccccagctcaaggccttggagagtatcaccaagaaattcgaggccaagaaccctgacattcacatcaagttgaacccgggcaccaacaccaacgagaacgacatcaaggtgcgcctcgctggccataacccgcccgacatctggaacacccacggctggtcgcgcgatcgctacgccaatttccttgagccgttgcaggatcgcccttgggccaagaggatgaagccaatcggcaacgacgtctacaagaccaaagacggcaagttctacgccctgccagctgacatccaggtgtctggcatcatgtataacgagactgtcctgtccaaggcgggcatcgaccccaagtccatcaattcttgggatgccttcaagcaggcttgcgacaagctcaagagcgagggcgtgaccccgattatctccagccccaaggatccgggcccggatggcgatctggccgactacgtgctgccgggtctgtacaagagcgacgagctggcctcgctgaagtcaggcaagttcgacaccaagatttaccagggctacaccagcatgatcagccagtggtcaaaggccggctacttcaacgaggactacacttccgccacggtggatgacgtcgcccggctcatggcccaggacaaggcgggattctacttccgctccaatggcaacgcccagctgatcacctcctacaaccccaacgtcaagctcggtatgatgccgctgccgtccaatgtgggcgagccttacttctcgactggcgaggacaccctgaccttcggcgtttccaagaccagcaaggtcaaggatgcggcgctcaagtacatcgacttcatggctgagccagagaacctgcaggagctggtcgatgtgtcgatgaacgactccgctttgaccggcgtgaagtcggccctgggccagttccaaaccacctatgactactgggtcaaggacaagaagaccaagaccgtgcccttcttcgaccgggcttacctgcccaacggcatgtacaacaccctgtacaagtccaccgatggtctgatcaccggccagctgacgcctgaaagcgcagccgaccaggtcaagagctccttcgacagcctctacggccagaagtcctcttgagaagagcgggttaagcgtagctgaatcgggcgccgtcctgccgccgacgcgggtcgtcggggcggcgcccactccccgggttgtgcccgccgccggaaggccgggccgtctcgtgcggaaaagtaagaattttcaggcaatatagatgggagccagcgatgaccgacggagtagtaagtaccagctcctcgctgccggacgccgaagcgaacgacggggcggtggggaatccacgagcgggtggcggtaaagtgccggtccacaagcgccattcgttcaagggcgcttcggtcaacctcttctatctgccagcgattctcgtgctggtcgtgttcattatttaccccttgctctcaggcatcgggctctccttcacgaactgggatggctacaacgacgccaaggctttcgtggggcttgcgaattacaagcagatgttcaccgacgcgaacttcaagcagattgtgctgaacaccttcatttacggcataggcagcacgattctccagcaggcgctgggcctggctttggcgctcctgctgaacgccaagatcaagggccgcacgctgattcgggccatcatctacctgccggccctggtggcgcccgtcatcatgggcatcatgtattacttcgtgttccagtaccagcagggtgcgctcaacgccttgctttcggcgctggggatgcccaaggtggcctggttcaataacgccgggctctctgtagggatcatcgtcgtcgtcaactcgattcagttcgtcggcgtctcgatgatcatctacctggcgggcctgcaaaccatggatcaagaggttgtggaggcggctgaggtggacggcgcctcgggctggaagaagttctggaacatcaccctgcccctgctcgccccttcgttcaccaccagtgtggtgcttaatctcatcggcggattgaagctgtacgacatggtcaaggtgctcaccggcggtggccctggctactccacgaactccatctccacctacatcggcacggtttacttcgataaccaggctgcggggtacgcttcggccatcggcgtcttcctcttcgtcctgatagccatcgtcacctggctggtcaacaagggcctggccaagctggattgggaggcatgagcatgacaagcgcaatgaactcgaattcagcgctgaatggtaagaccagggctgagcgggactaccagcgtggccgttgggcgatctacctgtttttggccatcgtctgcatcgttcaactgctgcccttctacttcgccattaccgcatccttgaagccggccgacgatatgtcgtcggtggtcacgatgcgcatgcatgacctggcttggagcaactggtcagaggccatcaacgagggcggcatcctgcgcgcggtcctcaacagcgtcatcgtgaccgtgggcaccaccttcctggtttgcgtcctcggagccgctgccgcttatccgctggcacgcaggcagacccggtgcaataagtggatttcgtcattcatcttgtcgatgatgatgatcccgcccctgagcatcctggtgcccctgtactccttcttggtcaaaatcggaggcgtcaacaactactggggcatcatcctggtgctgacggccaccaacctgcccttggccgtgttcctgtacagcgctttcatccgggctatccccccggccatcgacgaagcggggtcattggacggggccaacaagctccaggtgttcgtccgccttatcctgcccatgctcaagccggtgacggcgaccgtggtcatcatgaccgggtccacggtctggaacgattacgccctctccagctacatcctgaccgatccgaacgcccagaccatcgcgccgcgcgtggcctccttcttctcggccaacgccaacaacctcggcatcgcggcggcggcatccctgatggcggcggcgccgatcgtcgtggcctacatgttcctccagcgctacttcatcgccggaatgatcgcaggttctgtcaaatagtttcgttgtcgctcacaacagtagatatggagccaccattgtgcaggtggctccgacagtcggcagaagctcggaatggagcgccgtccaaggaaggattacaatgctgtttccctcagtacccgtgaatacccgctcccagacctatctggcattggcggattcgaccgtcggtgatgacctgccggccgcttgcgagttgttcgcggccggctcggagagcgtcgcctcagtgcaagggccggcgcaggccgtcggtcgcacccccctgttggcggagcactcgcagaacatgttcctgcacccagggattgaggggcatcggctggcgggcgcgggcgcgcctgaaggccaggcggccggcaggaattggtcgccccgcttcctgctggaccgcgagcctgaactgggggagcggcgactggccttccatgccacggacaccgactgcggtctggagctgacgactgaactggaggccctgcccggcggctccctgcgcatccgtcacaccctgcgtaacgccgcccccggtgactacctcctgcaaagcctgagcgtgcgcttgcccctggctgatgatcagagcgagattctggacttcgcgggccgccatgagcgggagcgccaaccccagcgccacagcttggaggacggcggctgggtgcgcgagttccgttggggtcgcaccggctacgaggggcccgtggtgatggtgggcacccccggtttcgacttccacgacggcaaggtggtatgcgtgcaaccggcctggagcggcaacaccgtgctccgggtggaccgcaattccgccacggacgcgggtgtgagcgctggcgagctgctgctgcccggcgaaatcgagctggggcaggggcaggagtactccactccttgggtgttcgtcaccgcgtccaccgcgggtctggacccgatcatgcacagtctgcatgactgggagcgcaccctgcctgagcatccgagcgtgcagccggtcacgctgaacgtgtgggaagcggtcatgttcgaccataaccttgacaagctcaaggatatagccgaccgagccgcccggataggcgtggagcgctatgtgctcgacgacggctggttccatcagcgtcgggatgataccgctggcctgggtgactggtgggtggacccggaggtctggccccatggcctgagcccgatagtggattacgtgcacgataagggcatgcaattcggcctttggttcgagcccgaaatgatcaacccggattccgacacctaccgccagcacccggactgggccatgcgcgcccggagcgagaacccgcgactgcagcgcaaccagctggtgctggacttgaccaatccgcaggccttcgaccacgtctaccggcagatgagcgcgattctggaggagtaccggatcgattacgtcaagtgggaccacaaccgtgatttgctggaggctggctccgaggttcatagccgccgtccggccgtgcaccagcagacggaggcctactaccggctgctggacaagctccgccagcgcttcccgcacatcgcctgggagtcatgctcgtcgggcggcgagcggatcgacctggacgtgatagagcgggtcaagcgcttctggaactcagacatgaccgatgccctgagccgtcagctcatccagaggtggaccctgcaaaccgtcgcccccgagtacatcggcgcccacatctcccaaccctgctcccagcagacccaccgctcgtactccctagacttccgggcagccaccgcagtgttctgcgccttcggcatcgagtgggacatccgcaccgcctcgccggccgacctggaccgcttggccctgtggatcgcgtggtacaaggctaatcgtggcttcctgcactcgggcgacttcattcgcctggacgtggccgacgctgccgtgatggcccacggggtggtcgctaaagacggatcgcgcgccatcatcgcgcacgttcaatacgaggagtcctccagcaaccgtggagtcttcctgcgggtgcccggtctggatccgtcggccaagtaccggctcagctggaccagccccattgagcctgaggccagcctggagagcttagacccggccggtccgctcggccaggagagcgtgagcggtgaatacttgtgccgcgtgggcttcctcatgccgcgttgccggcctgagactgtccggatgattgagatcacccgcctgtaagtcgaacgcccgctgagcggttccggagcgcgcctccctggcgctctagggatggttctccgggcggttgtacagttaggtgggggttcgcgcgcccctgtcagagccgcccggagccgcttcaaggccccggagcggtatgcgctacaaccacaagactagggattacagggtttcatcagtgagcatgggcaagaaggacggacatggcaggcggtcgaacgagtgggtgaaaggcaacgccagccagcggccgtccggcaccgtcaaaatctcctcggaccgcttggaccgggccattcccctggatatgaaagacatcgagcgcgattacgacaagccgattgaggaggcttgcatcgcggccaaggccagcgtcatcatgcgcgtgggcatgttggacctggggtcgggcacaggctccttccgtgtgcgtgagatgatgcaccgggtggcctatccgatgggcgtgcacgtgcgcgccgacgtgaacctgaccgacatcgaagccacttgcaccgatgggtccgggcgcatcaccgaggtggtggacctgccgaccaccggcgtcaacaccgagcgcatctggctcttggagcacttcgccgactggctctcggtcaactgcgggcgttcgtccacctaccaccgcgcggcgctcgtctcccaggagctggtggaccacctgtgcgaagccaagtctcattgggcggtgcgcaaggcccgggaagccgaggccgccaaagcgcatgaggtagcacgggccaggagaggttcgcaaccgcgtccggggggcgttacggtccgccaggcccacgagcggctcaatctcatcgagcaccgcaagccgctctacccgccgctcttctccgccttcgcgtcggccgtggcttgcgcttcgttcgtctgcctcctgggcggcggcctatacgacatggcgggggctttcattggcgcgggcgtcggccagtggattcgccgcctgctgctggagcggcggatcaaccagttcttcgtcaccgcgatcgccgtcgtcgtcgccgccttggcttgcgtgggcaccttgcggttcgtgggtttgttcgacccggttgccctgcgccacgacaccgcctatatcggcgccatccttttcgtcatccccggcttcccgctggtcaccggcggtttggacctcgctaagatggacttcccctcgggcgtgcagcgcctgacttacgcctttgcggtcatattggtggccacgttgggaggatgggccgtggcccacatggtcaggctcaacccgcagggattcgaggccttggacctgaccccctgggcgaccgccggcctgcgcgcgctcgcggcattttggggggtgtggggcttctccgtgctctttaactccccgcagcgcatggccctggtctcggctgtgattggcgcaatcaccgacaccttgcgcctggaatcccaggatttgctcggtatgcccccggagatggccgcctttctgggcgctttcctggccggtatgctcgccacggcctggcgctcttcggtccgccacggttggctgccgcccgacctgggtttcccgcgtatctgcctgaccgtgccctcgattgtgatcatggtgcccgggctctacatgtaccgggctatgttctacctgggccagttcaatacgctaagcgctctggactgggccttccgcgccttcatggtcatcatctgcctgccgattggtttggcgacggcccgtgtcatcgccgaccgctcctggcgctacgacgtgtgagcccggccggctgcgccgcttgcgcgaacggtcagtaggccatgcccatagcggagcggacctggtccagggtctcttcggcgatggcgttggcgcgcttgttgccttcggccagcacatcgcgcaccgaatccatgtcgcgggccagttcagcccggcgctcgcggtggggggccaggaagtcgttgacggatttggttacatacgctttcagggctccggcgcccgcatcgccgatctcctcggcgatttgcgccggatcgcgcccggtcaccaggccggcggtggtcagcagggccgaaacctgagggcgtcccaccgtgtcgaaggtgatgcgccgctcggagtcggtggggctcttcttaatcagtttggctgtctcctcggcgctggcgcccagcatgatcgaattgccgtaggatttgctcatcttgcgcccatccagccccggaatctccggcgcgtccgacagaatcgccgccggctcggggaagaccggattcttaagcgcgtagcgctcgttgaagcgacgggcgatcgtgcgcgttatctccacgtgcggcaggttgtccttgccgattggcaccacgttcgccttgcagaacagaatgtcgcaggcctggtggacggggtaggtcagcaggagcccggtcagcgcgtggccggaagcctccatctccgacttgaccgtagggttcctgtgcagctcagcctcggtgaccaacgagaggaagggaagcatgagctggttctccgcaggcacggctgagtgcgtgaaaatcatggttttcgtagggtcgatgccagcggccatgtaatccagcaccatgttcagcacgttctcctgaatgtgctcggtggaatcgcggtcggtgatcacctggtagtcggcgatcacgatattggtgtgcacgccctggttttgcagctccacccggctcttcagggagccgaagtagtggcccaggtgcaaacgcccggtgggcctgtcgccggtcagcatggtgaagtcaccgggacgggcgtccagcttcttcgctaccgcgtccgagcgcttctgcgccgccaggaagctcgcgctgatttcattgcctgccgccgtcacctgctgttcgccgcccatgaccctgcctctcagcctgttgcgcgcgtcggtcgggcgcaagtgttacggaatattgcttttatcgtaaaagtccgagccgacaagctcccaagtggtaacctcgaaagtaatgcatggataacaacgcgaggcttcagggccgttaactgacgaagggggtcggatgggccgcggacgtcagaaggctaagcagacgagaatagcccgtaagctcaaatatctgacaactgacactgattacgaccagcttgcgaaagagctgagtcagcgcgattccagcgaagcgaggaccgaccccctccgggtagtggaggagcagttcggcgctcaggcgggtaaggacaatcgcgctgaccggggtccatcggaccaggcttcggctgccgcactggacgatgcttttggtggcgaacccgctggcgacgatgacttggacgactacgcgcgctgggccgccgaggctgcggccaaggccacgtcgggcgagattccggccgttacgccacgccgcaagcccataccgattcctgtgccttccgcgctgagccataagccagcctccaaggccgcagtgaagccggttgaagtttcaaccgccgttgtgcctgagtcggcgaaggtcgcccctaagcgggtcgcaagccctaagaccggtgccgctaagaaggcgggttcggtggtgaaggcgaccgccaaggcggcgaagaaagcgacttcagccgtcactaagcctgctggggcgaaagccgccgaggccgcaggggcccccaagcccaccaaggccacggccgctaagaagaagaccgctggcacctccaccgccgccggggctaaggccaagggcaagtcggcagccgcaggccgtgccacgcgcagcagcaagaagaaggccatgccgaccacggctacggccgcctgagcctcataaggctccagagcccagccgttatctatgaacgcagcgcgaacagccgcccgccgtcaagccggtgagggtggcgggattgagccttagaccaggggcaggagctcgctcagatcgtcccgctcaccgagggcggtgattcgtccggcctcctgctcctcctgccaggaagtcacgccggctgccaggcgcagccacacctctgggtccaattcgatggtgtccggcggggtcaggttgtgggggtccgaggccggcccgtccaaaatcttaatcgccccccacggcgctacgcgcacctccacgcccggtccgggcgccttgatctccagcatgtgcagggagtagcgcacagccatggccagttgccgccgaggcatgggcgggcccacctccagccgcgccgccgcgttcggggcctgcgccgccgcctctttagccgcgtcccgccaggcgagaaagtcccgccgcccctcggccacatcattctcgcgtataacgctcatgctttgctcctccctccccgaagcatacagtgaaccccacgcaggaacgggctcccgcgtggggttcactgtatgccgacacgcgccaggctgacgccgaccttaaatcttcgatttgggtgctagcagctaacctagctgcgcggctcagccctgggcaggactggcggtaggtgtgctgaagaccggcccctcaccctcggcctgagcgcccttaccttcgctggacccggactcgccctgctcgggcagccccaggtccaccggtgacgaggagttctcccaaggctcctcccaggggtcgtactcggggttctgctgcttgtagacgaagaacgcgataacgcccgccagcagtgtgccgaagagcagggcgaagaacttccagccgttcgaggacttattctccatgatggttcctttcaaccgttggctcgactacccgcacagccggcctaatgcttaccagtttaatggacattatgtggcggttgcgtgtcccttcctaagcgcctaagttggcccggttcgggccgccgtcccctccggccgcctatgcggccacaaaccgttggctgcggctccgtggtcggtctggattcgtcatcgcaagccgtccttcgcgcaaaagctgttcgatgtagttacggcgagcgtaatacttgcctatacccagcaattcggccacgtcctcagctgtttgcggagtctggcagagctccacaatggccgccagtttgtcctcccgatccatcgcggtcccagcagcgccggcgagaggcacgcccatttgcgccttggctacagcctctggagcgttggcgggctcgtctgcgacactgtagaacttgacggtgaaggaagcttgagcctgccggctgaggaattccaccggcttgtagccgcgttccctggcttcctcctggatggcgggtatgccggagtgccggttctcggctatatgctcaatctccagtaggctcaccaatgtggggtttcgggtctggctgttcgcgaagccaaattcgttcaagctctgccccccatagatgccgcctgggttggtgcattccagccggtcggagaaaagggtaagtctcactggcgaaccgttgcagtaagggccatagtcgcggtgcatcagggcgttagtcagaatctcgcgtacggcggtctccgggtactgcggcaggtcgatgcgcacaccgtcgcggattcgggtggtggtcttgctgttgcgccgcacaacggccatcgcgccctcgatcatctccccgataccgccttcgaatcgcttgctatctatgaagcgctcgtcgccgtttcccttgcccagctcggtgccggccacgaccgaggcggttatgcataggttcgggtaggcctgctgggggtagtcgcccagggtcatcagatcagctagtgtgggtttgccgtccttggtcacgccggtcagttccagaatctcgtcgtcctggcgccgggccagtttgggacgctcttgcgtggcttggcgcacgaagtcccggaccgccttggcatccagcatgtccattctcgcgtcgggtgccaggctcgcatcgtcccggcgcccgtccttgaaggattcgatttcatagagttgggtggcgctcatgcgcacgtcagcgtcgtttacgcgggtgtaggcgctttgggttatacctgctttggtccggtataccgagcgttgactcatgggcagaccgctgatgaaggcgcagaccacggttttgccatcgaaggaggcttcatcgaattccgggcgcaccacgggtgtcatcgcctcgccctgtccgactacttcttttttgagttgctgcgcggcgaagaccccagtggtagtgaagtcctgcccctcgtcgatgccgaacaggatgaatccgccttcgttttggttggaaaaagaggagagtgagtcatagactctaggcgtgccttccgcagcggccttgacctcgatgatctgaccttcgcgctggtttcgctggacttgcttgaccacttccgtcagggaggcatccgcatccagttcccctgccaagcccttgagtggtccctacctcaaaattgagaataatgttgctcatattgtaaatcgatatttcaaaattgacgattttcttgacgaattgggagaaagtgttgcgaaattagtaaagtagattgcgaattcagagggtggtggtgcgaatatcgcaagaattgtgacagtgcgtcgagtttttggagtctgggatttcgaatacgaagaatgggtctacggattgggaagaagtgaagtgttgggaggagtgcggcagagcatgccgcgccccaggggaaggggactgccggaccgcgtattttagggattgcgactgctctctctggttcgttcgggcgctgattgcggtacgcggcgggtgttccagccggtgctgccgagttcgatcaagagaataatcgtggttaacggtacggtaatggcgctcgcggtagggaacgcgcccgcgaatttccctgtgcctatggtgggccacgcatacggcgaaagtagcgggcgggcagttcagacccgcggtccgattccccaacccagctcggaaggggcacttatctcaatcggtcagaagtaggcctcactcttgttcccggcccgtgacggacggtgcttgagcgcttatattcatgtctttgaatcggtgttgctcagaagcgcacatgggtcccgctgcgcctccagtccgggagcggtcggtaggatggggggcatgacttacgagcgttcccctcgcatatctacagcacgttctttccggcaggagccgcagtacgggcagccggcggtggggccggagtactacccttttggcggcccggaaccggagggtgcgccggagccgaaagggcctaggcggtcaggccgcctcaagtcgcgcctgcgctattactggcaggatgacgggccggtcgtcaccgcagcgattacggtggcctgtctgctggtctggctggtggagctctacggctactacctgaatccgcgcttttacgagagcctgctgacccatgcggccttcatccccgccttgtcggcccggatgccctggatgtacgtgacctccatgttcctgcacgccacgaacgtgacccacatcttgtttaacatgctgaccctgtgggcggtgggcccggtgctggaacggatggtgggccactggcgctacctggcgctttacctgctcagcgggattggcggtgggctggggatgctggtctcggcggccatcagacctgagggctggatggtctcggccgtgggcgcttcgggcgcgatcttcggactcttcgccgccgtactggtcctctaccggcgtttgggcaccgacatccgctccatgcttgtcttcgtggccatcaacctggccatgcccttgttcgtttcgggcatcgcctggcaggatcacgtgggcgggttcatcgtcggtggcttgtttacgctgctgctggtctccggtctggggctcctgcgggggaaaagtctcaacactcgaatgtggataagtggattggttctgcttctggtgattatcgctacagccttgttctgctataggggcaaccctataaacggcatggcgctgcccttctgaggggttttcggcgctactggtgaggtaggaattacaagcgtgtaagctatccacagttgtgggtaaagttgtggataagcggaagataactgagcattatcggtggataagtgtttgttggctcccgggaaaccatctgtgcgcgagccccccccccctcgctttgccagcgtttgggaagagacggaaaggggccccgcgccggacgcgcggggccccttaacagtggctgagccgaagcggactgaactaccgccaccacatggtcataaagaatccgactagcaagatgccgaagcccaccaacaggttccactggccgattttcggaatggggaagctggtgtggcccatcgtggctgccaggtagtagaccacaatccaaatcaggcccaggagcatcagcgtgatgaacaaggggacgaaccaacgggggttggcgcgcgtgctcttaatcgtctcctctacccggcgggagttctcctcttgccgctccacgatgcgccgcatctgcggggtcatgtgtttcttgtcgacgtcttggttcagcacagcctcgaccttgtccatggagatgccgtactcgtcgtctgaaccctcggcgttgcccttgcccgcgcccttggcgtccccgtcgcctgcggcgcgtccgctggcctctgacccggctttggctttggagttcttcatcgcgccggcctcggaagcggccccttccgcctccttgagctcgccgtcaccggtttcgccgtcatgggcttcgcgctctgccatgagtaaactctccttcagtagtctctatagacatagtaacggttacactcgaaagtaactatatcgcaagcgcgagaaagggaaccgcatggctggcgcgaacccacagggggatggagggcgcaaaaaccggtcccgggccaagcacggagcgcggggctcggccttgggcaccttgtcggtggcactcatcctggcgctcgtgggatacatgttagcggtcaacgtgcgcgtcaaccgcacagtgaccaccagttcggacaccactggactgttggaggagcgcgagggcaaggtgcgcgagctgcggcgcgacatcaaccagatgagctcgcagatcgacgccttgaagaatttcaccaacgggcaagacgtgtccaaggtgagcgaggacgcgggatcgggcactgtgctcaaggccgtgcgcggcccgggcgtaagcgtgaccttggatgactcgcccctgtggcagcagaaggtggatgccaccggttccgtgcccaatatcaacgattacgtgatccaccagcaggatatcgaagccgtggtcaacgctttgtgggcggggggcgctgaatccatgcagatccaggaccagcgcgtgctgccgaccacagctgtgcgctgcgtgggcaacgtcctcctcctgcatgggcgcaagtactcgcccccgttcaccgtgcaggcgatcggcccggtgggtaagatgaccgcggccctggatgattcgccttcggtggggatatacaaggaatacgtggcaaccttagggttaggttggaagctggaacgttcggacaaactggagttcccccaggccaccgccgtgctccagcctcttcagtacgccaccgttgatgagaaagcgcagcaatgaatcaagacccttcagtcacaagcaggaacctgtcgcgtcaatccgcccgcgaacggcggcagagcgggctgtcaaaggcggcgggcatagccgccgaggtgttggccactctggccgtcctgtgcgccctatacatcgcttggcagctctggtggactggtgtacagtccgagcacgcgcagattcaggccaggcaagcgtcgtcttggtccgcacccgcctccggtaagggcggcgcggagcgtatcgcgcccaagcaggagggggagcccccggtccagccgcagagcgctcagaggggggagctgatcgcccagctttacgtgccgcgctttggcaccacctgggaccgtaacgtggtggaaggcacctctgcggacctgctggcctacggaggcattggccattacacgcagactcagatgcccgggcagaagggcaatttcgcgctcgccgggcaccgggccggttacggtgagcctttctccagcgtggacaagcttcaagagggcgacccgattatcgtgcgtaccaaggattactggtacgtgtaccactacaccagcaagaaagtcgtggaacccggggaggtgagcgtgatcgcggccaatcctgagcatccggacgaggccgccacgaaacggatgatcacgctgaccacttgcgagcccaagtacgcgaccgccgcccaccgttggatcagctggggcgagttgaactactgggccaaggtctccgacggcgtgccccaggagctggcctccaagagcaacgggggcgtggtcttcgagaatgagcaccaggggggggcgctggcccgtttgggctccctcctgccggtcatcaccgtcctcttgctgatgtacatcatcatctacctggcggccctggtcgcctggcgctaccccaagctgcgagccatatccgacggccgtgagcctaagccctacctgtccttctatggttggctcagccggcatcaggcgggcatcacgcccgtgcggtgggtgctgatggccttgctggccctgatcgcggtgtgcgccatgcttgagtgggtgttcccccggatggcggccaacatacccttcatgcgggccatatccaattacccgtccgtatagcctgggacgcccaaggcgtaagggctgggcgcgatagggtagcggacgcggaaagaggggctggaaaccaatccagcccctctttccgtcagctatgcaaagcccctgcgatgccgccccccacttgccggttcccctgcctgggtcagcgcagggaaccctgttccaccagagcctgcacttcgggctgcaggtggttgtaccgttccacggttcggtcgaagtccacaaagaagagccggtaccaggtcaggagggtgtagatgttccacacctgtcgacgcccgtctatccggccggcgtagttgtcgtcgagcaggcgcaggatccgctcttggtcgaagatgtccgtcacccactcctgctcgaacaggttgcgcacctgccggtagtatttctcctcacgcagccaggacttgatggggacggggaatcccagcttggggcgcttggcccactcgtcgggcaggtggcggcgggcggccttgcggaagatgtccttggtgttgtgccggttgaagagcatcttggagggaatcgaattggccaactcggccacctggcggtccaggtagggcacgcgcagctccaaggagtgggccatcgagatcttgtcggccttctggaggatgtcgttgagcatgaagtggtgcaggtcgatgtactgcatgcgcttaacgtcctcagcgcctttgaccttggcgaaatcctcttggtagatgccgttgacggtcaggtcgttgcggtactcgggctgcaggatcgcgttggcctgctccgacgtgaacatggtgggctgcgccaagtcgtacgcgaatgcttgtcccgcgtagtactcggcggggtcggcggtgtgcgtgtagagctggacccggccggggaagttgggcatcttggccagtaggtgccctatgcggcgcttgaggccggtgggcagggagcctaaaccgtccgccagggctcggatgaaggcgttggaggaatggtcgccgtaattcaggtagccggcgaacagttcgtccgccccctcgcccgagagcacgaccgtgaccttctgccgtgccaggcggcacaagtaccacaggggaatcacagaggggttggcgtcgggctcatccaagtggtactgcatctgctcgaaatcacggaaagcctcgtcggccgacacggtggccttgttgaagtgcaggccctcgtggtcggccagggcctgggccgggcccacctcgtcgaagggtccctcgtcgaagttgaccgaaaatacctcctgcggccgcaagagggaagtgacgtaggaggagtccacgccctcggacaggaaagcgcccactggcacgtccgccaccgtgtgcaggtccaccgactcctggaccgtacggtcgatcgcgtcgatggtctcctgctggctgcgcccatagtccacgtcgtaggaggcgtcccagtactggtggacctggaagtcgtcgcccttgagctcgaaccagtggccgggcgggaagcgccgcacccccttgaagaaggtctccttaaggtcgttgtactggttcatcaggaagggcttaaccgcctggcggttgagctcgggcttgaagttgggctccttgaagaaggccttgatctccgaacccacgatgaaggcggagccttgctggtagtagtaaagcggcttgatgccgaagtagtcgcgggcgcccaggagggtcttcttgttgtcgtcccaaatcaggaaggtgaacatgccgcgaatccgcttgagcaggccgtccatgccccactgctcgtagccgtgcaggagcacctcggtgtccgcctcggacttgaagacgtggccggcatcgatcagctgctggcgcaggggctggaagttgtagatctcgccgttgaaggtgatcaggaccgagccgtcctcgttgaagatcggctgcttgccggatttcaggtcaatgaccgacaagcggcggaatcccatggctaactcgtcgttggcgtagtatccggagcctaactcattggggccgcgatgctgaatcatcttcatcatggcctggatggtgatgtccttgtccaggacttcacggtcgcggaaagcgatgatgccgcacatgccgggctcctctcggtaaggtatcgaagtatagataatagtcgccgctggcgaatggcgcccgcggcctggcggcttagacggccgaatcgaggcggcagtagggcgctatagccctccacttagctggaggctaattggaggaagtggtgatgttgatttgcgtgttcttgtcgaccgagctgccggggccggggctgaccgcggtgactttggcgctgccatccgaggggccgtggagggcgtagttgttcagccccgctgcgctgagctgggccttgtaggagccgagcgtggtggtggagtcgaaggggggcacggtggcattgcctggttcggtggtcaaggtgaccgtatcggtgtccttcttgatcgcggagcccgcgcccggggtctgcccggtcacgatggccgagtcgtccgaggggccgttcacgctgattttgatgcccgccaggatttgcttggcctcgcccagggtcttgccgttcacgtctttgacggccatgccgtccgagacgttgacggtaaccatcgctccttgggctacggaggtgttggccgccggatcggtgtagatgaccgagtccttggccacggtgtccgagtgctgcttctggaccgtgatgttgaagtgctggagcatggccttggcctcgtccagggtcttgcctgacacgtccggcaccttggtcatgcccgaggagatgtagatgaggattgaggagcccttgggcacggactggccaccggccggatcggtgcgggtcacctggttcttcggcacgtccggcgaatcctcaatcgaagcggaggggctgactttgaacccggctttttccaatttgtcgcgcgcgtcgtcctggctcaggcccttgacgtccgggatcttagtggactgggggccggaggagaaccagaccgtgaccgtggaacccttcttggcctggacgccgcccttggggttttggtgggtgaaggtgcccgccggctcggccgagtcggggtcctctttctcctcgtacttgaagccggcagccgtgaccttttcccgggccaggagcttggacatctgcgcgttgattgtgggtacggtggtctcgtcgcgcttgtcgcggttgaggaagccccatgcgcccaggcctatcagcgccaaggccaggatggcggcgatcgaggagatgatgattttcttcttgcgcttcttggcattggcggccttgcggctctgggcctgggccaccgtctgggcggtcgcgccggccaagggctgattggccgggcctaaggggctcatggcctgggtggctgcggtctcgtcgccggtcgggggcagggccgccgtggcggcctcctcctcggcggccttgcgtgccttcatgttcgccagatcggcgagtgggttgaaggcggcggccacgggggtgccgccgttcatgaaggtcatgatgtcgttcttgaacccggaggccgtcgcgtagcggttcccccggtccttggccatggctttggcgcagattgaatcccacatcttgggcaagccgggcacgatggcggaaggtggcgtggccacctcggagacgtgctggtaggcgatagccaccgcggagtcaccgttgaagggtgggcgcccggtcagcatctcgtagaggacgcagccggccgagtacaggtcggagcgcatgtccacgttctcgccccgggcctgttccgggctcaggtactgggcggtgccgaccacgccctgggactgggtcatcgtggcggcggagtcgtccagggcccgggcgatgccgaagtccatgaccttgacgacgccttgctcggagatcatgatgttgccgggcttgatgtcgcggtggatgatgcccatgtggtgggagtattccaaggcgttcaggacacccagcatcacctgctcggcgtcgcgctggctcagggcgccgttggccttgatgatggcgcgcagggtctggcccttgacgtactccatcactaggtagggcacgcgctcctggttgccggcctcttcgaccaggagctcctcgcccgagtcgtaaatcgagacgatgttggggttgttcaactgggccaccgagtgggcttcacgcttgaaacgggttaggaagatctcgtcgttggtcaagtccgagcgcatgattttgaccgcgactgtgcggcccaagcgggtgtcgagcgcggtgtagacttcggccatgccgccgcggccgataagctggccaagctggtagcgcccgttcgccagggaggctggtagtgcgatgctcattgggaatcccctccgtttgctgtctgaggatcgtcggtcacaatgcgtgctcttttgttgaaattggtgatgaggctggtcgcagcctggccgccgatgtcagggtggtagaccaaggtgggtgcgccggccgtcggtgtcatgggccagtggggtttgctgaccactcgacggggttggaagcgccgccgctccaccggctgggtgtccgccagctggcggttcaggagtcgctgttcgatcctggacaaggtcctggagaccgtcagggcgtccttggggcggtcctcgggttccttagccagcatggacatgacgaattgggccagttgggtgtccaccgtgtccggcaggggcggcaccgggtcgttcacatgggcggcggcgatggctacggccgtggtgccggtgaagggccggtggccgcacaagccctcgtaggccaccactcccagcgagtaaatgtcggacttgggggtggctttcaatccctgcgcctgctcgggtgagatgtactgggcggtgccgaccaccatcccgtcctgggtcagctggccctggttggtggagtaggagacaccgaaatcggtgattttgacctcgccagagtccgagaccatgatgttggccggcttcacgtcgcggtggatcaccccgtggcagtgggccacgtacaggccgcgcgccgtctggatcagtatgggcagcaactcgatcgggtcgacgatgccttcgcgcttgtagagggcggcaagggagccgctgggcacgtactccatgacgatgaaaccgatgccgtcatgctcgtagtagccgaagagggcggcgatgttcggatgggccaggttggcggagttgtgggcttcggcgcgtaggcgttccaggcgcacctggtcgttgtccaaatccgtgcgcagggccttgatcgcgaccacgcgcttgagctctatgtcgtagccacgccagacttcgcccatgccgccctgggccaggcgcgcgtccagacggtagcgcccgtggatcagttgcccttgaatcagcttcatttcaggccctcctgcatgactcgcttcatgataggccccgctgaagctgcgccgtaggtagaggtggagtggacgacgacggcgaccgcgattttcggcttttgcgcgggggcgaagccgatggtccagccatcgttggagctgttggccacgccgatttgggccgtgccggtcttggccgccacttgggcgccggggatttgcaggttcggcgagtccttggtcacgaccgcttccatcatcgcggtcagggcttgggccgtgtccggggagaagggctgggagtagatcgcagggctggtttcgctcagcacgctcagatcggaggagcgcacccggtccactagcgtgggctgcatgagctttccgccattggccaccgccgcggcgaccatcgcgttctgcaagggggtggtgagggtgttgccttggccgattgacgcctgggccagtttgtcggggctggcgtcggcggggaatttggaggcggtggctcgcatgggccgaccggtggagtcagtgccgtccagggtgattgtggagccgaaaccgaactttttcgcctcctcgtccaaggcctgtccgcccagggatacgcccaactgggcgaatgctgtgttggaggagtaggccagggcgtcctggagggtgatttcgcctccggagccgttgcctgccgccgtagcgttggtcaggttggtggcggtgccgggcagggtgtaggcggcgcccgccggaaccctggagtccgccttgtacttaccggactccagggctgcggccgcgactaccaccttgaaggtggagccgggcgggtaaagctgggagctggcccggttgagcatgggattggcgtcttggttggccaggttggtgaagaactgggccgcttcggaagcgtcgtgcacggccagggtgttcgggtcgtaggagggtgtggagaccatcgccaggacgcgcccggtggagggttcgatcgccactaccgagccggactggccggccaaggcctgataagcggcctgctggatcttgggatctattgaggtctcgattgaagcgcctttgttctgcgcaccggtgaacagggtcttgatcttatccagccacaggctgtccgcctggccgctcagcagctggttgcgggagctttcaatgccacggtccgcgcggttggtgatcgagtagtagccggtaatcggcgcgtagatggggccggcggcgtacttgcgctggtactggtaggaatcgctgatggggtccgaatgggccagaatcgtgccgtccgaggccaggatggcgcctcggggggcgccgtactccacatagagggctcgggtgttgcgcgggtcctcgttcagggcgttggcgcgcacggccatgatggtcgtggacgacaagcccaggatcacgaacaggacgatgacggcggtgaagagctggcgtaaagccttattcatgagcggcttccttccccgcgcccgcccgggcctgcattggggctggctggcgctcatgtccgcgctggtccatctcgtgctcgcgcaggacggcaagggcctcatagcggaaggtgtccgaggaaacctccggggctgggcggttggcggcgttggatatgacgatgagcagggtggccagcacgcagttggcgatcatgctggagccgcccgccgccatatacggcattgtcagaccggtcaacgggatgaccaaggtgatgccgcccaccacggtgaaaacctggaaagccatcgtgaagaccaggcccgaagccaggagcttcccgaaaccatcctggattttcatggccacgaccatgccagccgccacgatcaccaagtagaggagcaggaccaccagcaggcctgacaggcccagctcctcgcctatggaggagtagatgaagtcggagttggccagcggggtgatccaggggtgaccctgccccagaccggtgcctaagaggccgccggtggccagtccgaaaacaccgcgcaccagctggccggagccgccgaacgccttgttgtactcagcgtcggagaaggggtggagccaggcatccactcgggcgcccacgtgggcgaagaggatggacgcggctacagctccgatgatgaagaagaccgcgccgatcgcgatccaggacttgcggccggtggccacgtagagcatggagacgaacatggcgaagaacatcagtgaagtgcccaaatcgtgctgcatgaccaagacgcccatggagaccgcccagacgacgatgatggggcctaaatccttgaggcggggcatgcgcatgcccagcaccttgggacctgccacagccagctggtcgcggtggtcgaagaggtaggcggcgaagaagaaggccaggaagagcttggcgaattctcccggctgcaaggtgtgggagcctatgcccacccagatgcgcgcgccgccgatctcccggccgaagtgggggatcatgggggagaggaggagagcgatgccgacgaccatgctcacgtaggagaacttgcgcaggacccggtagtccttcagggcgatggccaggccgccgcacagaaccagcgccgaatccagccaaatcagctgggtgacgcccacattcgttggctcgccgatcttggcgttgcgcatgtcgattcgggcgatcatcgtcacgcccagggtgctcaggaccgccaggcaaggcagaatcacctggctggcgtagggctgaaagacttccagcacggcccacagggctacgaagagcaggccagtgagcggcaggagcacggcgtactgggtggggaagccgccggaagtgcgttcgaacatttggaagaaggcgatgaaaccgatcaggagggccagcaggagcaggctcacgcgtcgcaagcgggtaataagggtcataggatgcctccgctcctggcggcagcgggtttaataacggacccgccggtggaggctgacgcggccggtttcgtcggtgaggcgggcttggcggaggcggacgccgagcttttcttctcgctcagcttggtttccttggatgccctgccctgcttgaaggagcgggattcgcggcggatcaggtcggcgtgctcgcgggcttggtcatagttggagaccgtgatgccctcctggagctgctcacgccaggaggagggcaggtcgcccagctcgatgtcggtgcgctccaccgggtgcgacagggacaggccgaatacgttcgtgggcaccccctgatagatggcgaccacgtcgcggtcctcgcccaggtaatactgctgctggctccagtagtaggccccgtaggcgccgcccgagagcaaggccagcaaagccaggaccgccgcgacgatgatcaggcggacgcggcgtttgcgaacccgctgacgcttgcggcgttgggtgtgctccttgcggatggccttggccacatccgggtcgtaggggtcggccgaagccgagccgtcctccttgcgcacaatgggaatctcgccggtgtcaggcacgtcacggtcgccggattcctcgcgggcgctggaaggttgggccatgcgctggggctcatcctgggggagctggtcgggtgccggtccgtgagccgggcccttcccctgatccggcgtagcgtcggaagcgccatcctgggcggactgggtaagggcggcggccctctgggctggtgaggacgaagcgctttcgcgcaacttgggcgctgcagccacaggctcgtggacgatgtccgctaaagcctccaggttggctgaggcggccccgccaatcaaaggggtctgccggggcaggtccagggcggaggcatccttgcgcagggtggcatcgccgatgactacggtcacattgtcggtggaaccggccttcagggccatcgtgaccaggcgttgggcgcactcgccttggtcgggcacgctggacagggcttcgctgattgtggggtcctccagtacgccgcacaggccgtcggagcagagcatccagcggtcgccaggctgggccttgcgcatggagatgtcggggcgggggtcgatgtcgaagtcgcccaagacccgcatgaccacattgcgctgggggtggctcttggcttcggattcagcgatgcgaccggtgttgatcaggtgctgcacataggagtggtcctgggttatgcgcaacaagcggccatcgcgcaggaggtaggcgcgcgagtcgccgatgtgggccaggacccagaagccgccggccagggctactgcggtgactgttgtgcccatgccggacaggcggtgctcccgcttggccttgccgacgattgcgtcgtgggcggcgatgacggaggcctccatcatctgcgacagtcgctgggcgtcctcgccctggtcgtcgtgctcgatgtgggccagggagcgcactgcgatcgtcgaagccgtgtcgcctcccgcatgacctcccatcccgtcgcacatggcgatcaggcgctggccggcgaaggaggaatcctggttgtcggagcgcacgtaaccgatgtcggagacggtggtggagtaaatgaagaggctttggctgtcgtcgatcgattcgctcatgggcctacctcaactcgaaggtggtggcgccgatgcgcaccggggtgccagtgggcaggatggtgggttcgttgagccgctggccggcaacgaccgtgccgttggtcgagcccaggtcctcaatggcccactggccggacactggatcctggtagacgcgagcgtggtgggaggagacgaattcgtcatccaggaccatggagttggaggaggcgcgtcccagtgtgattggttgtgcgtccaagggcagggatgaacccgccagagggccgtctatgacgaccagcagggagggttggccgccagcggcatgggccctgcggcggctgagggaggcgggttcgggtgtgggaggcgctgaaatggccgcagggaccgccttcctggcggcgcgctggcgcttgcgctgggtgcgagaaaccttcgggctgaaggtctcgatgtccttgcgtaaggaccggatcgccagccagaggaagacccagagcagggccaagaagccatatttcaatatggcgaatgtcagttcggtcagcataagtagttcgaccttacgtcaaggcctgggcttactcctccgcttgctcctgtgaagacgcccagtagaggatgcgagtgcggccgattgtgatggtgttgccgtccagaagggtggctgcggggacttggtggccctccacgtaagtgccgttggtggagcccaagtcgcgcgcgatgacgcccttgtcggtgatgtcgatttgcaagtgcttgcgggagatgcccgggtcgtcgatgacgatgtcgcaggccgagccgcgaccgatcaccgtggatggagcggtcagcaggtactggcgaccgttgatttccaagaccgggcagtccttggaatcggaggctgccgtggctggcgccgcgttgccctgcaccgactccgagctcaggcggaagtcgcccttgctcagttccaggtcttcctcgaagattacgacgactgggcccacgaacgcatagtgttggctctccgcgtacttggtcagattgtcggccagctcgttcgccaaggcctcggaaccccactgctcgatccggtcgaagtccggcgtggaaagctgaaaacggtattcgttgggcgccacggtgcgatcgcggcctacgggcatggcctgcgcgtcaatctcgcgttccagggcgctcgacagatcaacaggctgcagatctttggagccgaactttgaaaagacgccgttgacggcgccttcaacgctcttctcaaaacgatcgagaacgctcatagtcatccctttcttcgtaacccctctatcctacgcaagggtctcaaacatgcgcaaaaagtcacctaatgcttgcaatttcttcattccgcgccacccttgagcgccctttaagcccaaaggccaggcgggttttgggacgggtgggccataagatatcggcgtaaggtcgcgaacgccacaacggcgggcggtcagcgcgcggatggtaggagcagaaggcatggctgaggaaacggacgaagcggagctgtcggcgagccaggtgggggagcggatcgcgggcttcccgcaaaccaaggcgcgcaccctacgtttcacgctgggcgcccccaggtcgattcggatggctggggatgggcgacgggccttcttcctgcgctcggacggcccagaagactttgagaccagcctgtggatgagcgtcttcgaccagggtgacggccacagggaggtgctccttgctgacccccgcgacctgctggcggatgcggcccaggagcaggtaccagccgaggagcgggcgcgaagggaacgttcgcgcgaaggcggacggggcatcgtggcttacagcgttgatgcggccggtcatcgattggtctttaccctgggctctcgcctgtggctcacccaactggattcggatgggctgggagccagcacccggtctctgaccctgcccgctgagctgggcgaagggcatgccatcctcaacccagagatttccgctgacggcacccgggtggcctacaccaccggtcgtcaactggctgtggtgaccatcggagccgaccccgccgccgacgccgcgcgcgtggtgctggcgctggaggatggtgccggcgaagagcagaagctgggcctggctgaattcgtggccggcgaggagatggaccgctaccagggattctggtggtcgccagcttccgacgccctgctggtggagtcctacgacgccagccccgagccggtgtggtacatcagcgaccccgctgaaccaagccacccaggccagtcccgccgctacgctcaggcgctgactgcgaacgcgaaagtgcgcctgctgctggtgcgcctgggctcggatggctcggcctcgtctctggtccgtgtggactgggaccacaaggcttacgaatacctggcggtggtgcgctggcaggccaagcacgagcccttgctgctgctgcagaaccgtcggcagacccgagaccagatcgcggctgtggagctcggcggcggccagcaggagcctggcgccgactgtggcacgaagacctttggattcgatgacttgcccgacttgccctccctgcctacacggtccttgcgtgagcacgaaaacgaccggtggctggacctggtgcccgggctgcccgcttggacgcccgatgggcgcctggcagaagccgtaatcgacgagggcgcggacaccatccgcctggccctggacggtcaggccttctcgccggtcggctgccagctgcgagaggtgctggacttaggcgagagcgacgcgctcgcggtcgtttcctccgacccccgctccttcgacctggtccgcttcggatacgatggcagcctgaaagtcctgaactcacggccgggcgtgtggaccgcctccagggccgggcggggcatcgtcgtgtccgggcgcaccatgcaggagccgggcgtcaaagcctggcactccttgctcgcgcctggggccagcctggacgccttggcctgctgcggcgaagctcggccccagagcggggttgaggccagcgcccgcctgaccagccaggccgctgaccctggtttcactcccaacgtggacttcgtgcgcttgggggccgaccagctcttcggggcggtggtgcggcccagcgaatccagcccctgggcgggtgaggggaaactgccggtgctgctgaagccttacggcggtccaggtttccaacaggtggtcttcagccagtcttactactgggagtcccagtggtgggcggaccaaggcttcatagtgctcaccgcggacggccacggcaccactgggcgcggtcccgcttgggatcgggcgatttttgaggacatggcccaggtgaccctggacgaccaagttgcggcggtgcaggccctgccggacctggtgccgcaggctgatttgagccgggtggccatgattggctggtcgtacggcggcttcctgtcggccctgtccgtgctgcgggcgccggatgtggtccacgcggcctgcgcgggtgcgccccctaccgactggaccctgtacgacacccactacactgagcgctacttgggtttggaccgggaggtttaccggcgcaactcaatcatcgacgatgcgcccaagctgcgccgcccgctcatgctgattcatggtttcgccgacgacaatgtgtcggtcgcgaacaccctgcgcctctcccaagccctgatggcggcgggtcggccccacaccgtgctgcccctgaccggtatcacgcatatgaccaacgatcctaccgtcgcgcgcaacctgctggtccttcaacgggacttcctctaccaggcgctcggcattcaaccgcgcgattgagcctgcgccgcccccgcgcctggtctgcgcgtggcgtctggttttgaccccgctcttggctagattggtggacgtgactacagcagagcgaacaccagccttaacgccgggccccggccagattgcggcccaagcccaggctgcgggcgcgcgccccttgctgccccacggctgggccctggcgctctcagctctggtcctgggcgctctggctggtgtctcctccggcctgctttccctcttcctggatttggtggagcaggtgttccttggtttcgtcgagaattccgcccttcctggtccgttcggggtacccccgctgcggcggctgctttccgtgctggtcgcaggcgcgattgcggccctgatttggtgtctgttgcggaataagtgcgcgcgcgtgccctcagtggcgcaggcggtcaaaggcgcttggatgccggtgtggcagaccgtcgtgcatgtgctcactcagattctcctcgtggccgccggagcctccatcggccgcgaggtggcccctcgcgaggctggcgccatgctcggcggcgtctggttccgcctggcccatcgcctgggcctgcgccccagcgaccgtcggcttctggtagccgcgactgctggcgcgggattcgcgggcatttacatctccccgctcacgggcgccctgttcggggtggaggtcctgctgggcagcatggacctgactacggtggcggtttgcctgggcatgtcctcggtggctacgctggtcggcgggtcgattaagggtttcgaagcgtactatgcggtcagctcccagcctttccccctgcgggtcatgctgttcgcgctggtgaccggccccctggccgggttcgtgggcgctgccttccgccgcatgacctcctgggctgagtcgcatcagacgaccgggcgggccatcctctggcagcttccggccgttgccgggctgaccggtctgatcgccatcctccttcccgaggtcatgggcaatgggcgggccttggcccagaccgcgatgggcctgtccgccgaagccgcgagcccgcaaacaggcagccggctctggctgctcatcgccactttcctggctttcgggctctggaaggccatttgcacggtcctgaccattcgcgccggcgcttccggtggcaccctgaccccctccatcgcgctcggctcggccctaggagccatcctggcgctcatcgcctcgcccttggcgccggtcattcccttctggcaagccgcggtcatcggcgccgccgccactttggccgcctcccagcaggctccgctgatggcgttgttcatgctcttcgaggtctgccacctgcctgcgccggccctaatgcccctggccctggcggtggccctatcgaccgccgtctcccgtggcatcctcagccgcttccaggcccgcgcataacccccataatcccgacccggacgctcaggcaagcgccgtgcgctggaagccggtcggccttcatgggtgtatttgggcctgcgccggccctcagcggccatgccttctgcgcgtgccgtcctaccgggtcatgtgcgcgttcttggtccggcaaacgtgggaatcgcccggtccaacgcgtggcttctgcctctggcgctgggtaggctggttggtatggagcttgatttgattgatgaggggcaatacgagcagaccatgcgtcagacggtgctgcctgccttggaggcttgcaagcgcgaggggtggatgtgctcgaatgcgcctggagatgatgggacggcgcggtttggtccggctgacctgcctggccggcgtgccgtagttccgactagcccggaccgtctgcactatgtgtgctacgaggccgcccgtttcgacgagctggggttgcctgggtcccagggcctgcgccggggcgcggtcgtcatctcccacggtttcaccgaattcgctggcaagtacagcgaaatggcctggtacttcctgttggctggttacacggtctgcatcctggagcactggggtcacgggctctccggccgggggttggacgatccgaacctggtgtgggtggactcataccggcgctatgtggatgatttggccgtcttctgcaaggaggtggccgttgactatggcggcgacctgcccatatgcctttactcccattcgatgggcgccggcgtcgcggcctccctgttggagcgctatccggcgctggtggaccgtgccgtgctctcctcgccgatgattgctccgaggaccggcctgccgctaggcctgacgaatatggtcatgaacgccgcttgcggcctggggatgggccagtgcaaggtgcccggccaccaccggttcgacccccacttcgacccgggctcggtgggcaatgccagccaggcgcgcttgcgttggaaccacggcttgcgggccgctgaccccgcttatcagacctccgccgccacctacggctgggtccgccaggccattgcgatgtcacgggatgtgctgaaaccggccctgtgtgagcgggtggagggttcgaccctggtctttcaggccagtccggacgcgctcgtcccgcccaagccccaggagcgctttgtcaaccaggtccgcgtcggcggatgtcaaatcgacttggtccgcgtccccaacgccacgcatgagctttacaccatgcccaaccgggtcctgtccccctaccttgaacgcatcctgaccttcttctccgagcctgactccctggctggaagcgacggatagggaggccgccgccaggcctggcccgggtttgtaagccggccctacttgttgagcaccttttccgggtctgcgtcgaaggtctcgacgcagccggggctgcagaagtagtaggtcttgccttggtagtcgcgggtggcggcggccgttgtgggatcgatgctcatgccgcagaccgggtcggtgaccttggtgttctctgccatatcggcacttcctttcggttgatttgcattccttacattcatggtcccaccgtttgcggcgggtgggcgccggaccagggccttgagggcgggcatgtcgaccggtttggggtcgcgtacgggccgggcttggagcggggtgacgcgcaggcggttggcgttcaacaccaccgaaagcgaggagaaggccattgcagcgccggcgatcatcgggttcagcaggaggccgatgaaggggtaaaggacgccagcggcgattggaatgcccaagccgttgtatccgaaggcgaaccagaggttttcatggatgtcgcgcatggccgcgccggacaggtcgatcgctgtcaccgcgctctggaggtcgcccgacaccagggtgatgtcggcggactcgatcgccacgtcggtgccggtgccgatggccatgcccaggtcggcttgggccagtgcgggcgcgtcgttgatgccgtcgccgatcatggccacggtgtgcccctgcctttggagggccttgacgatcgtggccttgtcttcggggcggacttgggagaccacgcgctccacgcccacctcccgccccacggcttgagcggtgcctgcgccgtcgcccgtgagcatgacggccgcgatccgcctgtccttgaaggcttggatggccttggcggagctgggcttgaccttgtcggacacggctagaacgccggcgaagcggccgtcgactgccacgtagaccgtggtcttgccttgggcggcccatcgctgggcgctcatcagtgcagggtcgtccccggcgggcaggtcgatgccccgctcgtccaaaagtgccttgctgccgaccaggaccccgctctggcggccttcaccgccgtcgtggacgcttgacttgtccacatctgcttcagccgatcttgacttcgcgggttcagaggtagccgagctggattggagggaaaccagcgcgtccacgccagcgccggtcagggaagagaaagacaagactggcggcagtcgcagcccctgcgccttcgccccgtccacgatggctagggcaagggggtgctcggagtccccctctgccgaggcggccaaggccaacagctcctttcggctccagccgatcgcggtggcggtatcggtcagttggggcttgccgacagtgattgtgccggtcttgtcgagcacgatcacgtcaactttctgcgccttctgcagggcgtcggccgaccggtagagcacgccggaccgggcgccgcgtcccgtcccgatcgtcaccgagagcggcgtggccaggcccagcgcgcaggggcaggcgatgaccagcaccgagaccgcggcaacgatgccattgactcctttgggcaggggcccaaagagccaccagaccacgaaggtccagatggccaccagcatcacgccgggcacgaagatcgaggcgattttgtcggccagcttctggatgggggccttggaggattgggctgccttgaccaagcggatgatctgtgccagcacggtgtcctgccccacctgcgtggcgcggtagcgcagggagccggtcgagttgatcgtcgcgccgactacctgatcgcccgcctttttgagcacgggcatgggctcgccggtcaccatcgactcatccacagaggaggagccggagatcacggtgccgtccaccggcagcttctcgcccgggtgaaccaacacgatgtctccgacagccacatcgtccacgtcgatttgctccactgtttcgcccccctgctccccggtccgcagcaccgaggcggttttgggcttcaagcccacgagggaacggatggcgtcgccggtgccccgccgggcccgggcttcgaagacctggcccaggagcatcagcgtgatgattgtgcccacggcctcatagtaggggttgcgggcggaaggcggcaggatgccgggggtgagcgtgacgaccagggagtaggcgaaggcggtcatcgtgcccagggccactagggagttcatctccggggcgcggtgggccagggccaaccaacccacccgttggatgggccagcctgaatagaacatgaccggcagaatcagggccagctgggtccaggggttcatcaagagggccggcatgcggatgaacatgccgaacatggcggcggtgaggaccggaagggtgaagaccagggccacgacgaagcgggcggtcagggagcgaatctccttgttgcgctcgaggtcttcgtcctccgggtccccttgggccaggaccttgccgtgggccggatgggcgggctcgctcttgggcgtggtcgtggccatgctatgggcggatcgtgtgtccgccggtgagacctggttcggttgctctggcttcagctcggcgctcgccgggctccgctggttccgggaatcctgggcgtcgcgctcgctggagtcgctctggctgggcagggcccggagcatcccgtggagcatgttcatgccgcaggcgaacgggtaatcgccgggcttgggcagggtcaaatccaggctggtggtcttgaaggcgggcagcatctgatcgatgcccaaatcggggaagatcacgtgcgaggagcattcgccggactcctgccggtcgaagatcaggcggaccggccggttggcgtccacctggacaagctggggggagtagccgcccttgaccgctatgcgaatcgtctgcactccgccttcgttggaggcctggaccgcctttttgggcgcgaagaagaaccagatgatggcgatggtgaccagggccgctgcagcgacgacgattgcgttgagcaaggcgtgctcctttccaagggaactatctccaccatatacccccggggggtatagtggcaaaagctccactgcgggcagggccgacgtggtgctgcagaggctcggggtggtccaggccctggcctgggtccgacgcgaacgtgatgaggaggatgcaatggcgggatacatgaacgataaacagcgggtcatcacgcgcctgcgccgcatcgaagggcaagtgcgggccatcgaatcaatggtggaatcggacacctactgcatcgacgtgctcacccagattgcggcctccacttccgccctgaagtcggtggccctgaacatcttggacgaccatatgaaccactgcgtgcgcgaggcggcgcaaaaaggcggcgacgaggctgatggaaagatgcaagaggcctcggacgccatagcccgcctggtccgctcctgagtttgtccgggcattgcgcgtctctgctgcggtcacagacgacccccttacgctaggcgcgtgacggggtgataagagtgtaccgctgcgcgtctatgcttatgagggacttaatgctcaaccgggaggggaccccggctcaggattcaccgccggtcttgcgggggatgatgtaaggtggtgcgaatggctaaacatgctcctcatggcgtgcatgaggcgaagcatgtcccgagcaagtcgcgcaagcgcaaacatggtgccacgcgggatattccccagcatgaggaagagccgaaagccttaacgacgccggagcaggcgggtcaagtcgacaaagcaagccaggccgctcagtccggctgcacccccagaatggtttcatccttgcctgtggtggcgcccccggacgccctgtccgctgttgttcctggagttactcctgcgttggcggctaccgggtccgcttcctccgcgcccggctcttaccccgatttttccggccaagcggttacggcatccgccaatcccgcctcagccccttcttttggcgctcccgactttcagcccgaattcgacgcaggagcagccgcctccgtcggacccactggcgaatcaccggccccttggcagccgcaagcatcctggacaccggagccggcgtccactgcgattccttcgctcacggcccccgagctgacgaacttgccggacgacctggccttttcgatgccggcatccccgcaagcgcctctgagggctccgctcgcttcccccatgccacccgacctggccccgggccccactgagtcagcagccgcagccccgccgtcccttgatcggtcattcgaggcgcgatacgacgcccagcgcgcagcgctttcgcgaccattccccgactccccagcccccgctcctgccggagattcgcctactccctcttcgtccgtccctgcttccgcggcaccttccgcttccgcagcctccatgtcggtcccgggcgcgcgcccgccggtcagctccggcttaagcaaagcctcccaccgggcaggtcggcgtccgaagatggactggtcggtgctggtggcggtggcgcttgtctgcatgttcgcattgggctatgccctctacagcggcagcatgttcatgcagaaccacaacgaccacgaatccactcaatcggtagataagtacgaccaggcggtgcgcaagctcagccccaagcaaatcaaggcgatccgtgccgacatcaggcgctacgatggcaacctgcgcgccggaggacccttggaccccttctccggcaaaccagtcaattcccaggaagctggcaaggtggaggactacaccaagattctaggcaaggtcagcccggacatggtgggctacctgagcgtgcccaaggccaagttcgccggtccgatctactacggcgacgtcaacagcacgctcacccgaggggtgggctacctggaccagaccgccatccccgcggacgtcaagggcacgcgctcggtcttgtatggacacactggtttggatgatatgcacgtgttcgacgacctgtaccgggtgcgcaagggcgataccttctccgtgcgcgtactggatgccacctaccattacaaggtctccgacatcagcacggtcaagcctaccgagaccgactccctgcgtccccagaaggacaagacgatcgtgaccctgctgacctgcacgcccaagggcgtcaacgaccaccggctcttggtctctgggcagttgaccgatgtgaccaccgacaagcccaagctcaatcacacgatttcgcccctgatgctgatcgtcactgccataccgctggccctggcggtggtgggcgcggcttatgtggccctgcgccgccagcagctgcgcgggggctccagcgctggcttgaaaccgggcggcggccaaggtttgggggcggtatgagcgagcatagcggcaaggggcgtgcgggcgccagcaaggaccagtccaggctgaggtcaagtcgcgcccagggggcgcggcgggaggtggtgaaacccggtcggcccgggcacgctggtaggagcatcaagtggcggtccatggtcgacttgctgattttcctgatcgggctgggcatcttcatgtacccgctggtggccgcctatgtcaattaccagtccgcttccagcgcgattgacaactacgactcgatcgtcgagcgcctgaccccggctgaaaaagcggagatgtgggcgcaggccaagcgctacgacgaggagttgggcaagcctaccctgcgagacccctttaagtatcacaagctcaagtaccctgtcaacctctacaaccgcacgctcaacgtggacggcaagggcatgatggcgtacgtggagattccgaaaatctcggtcaagctccctgtctaccacggcaccagcgacgacgtcttgctcaagggcaccggccacatcgccacgacccacattccgaccgataacaagaccttgcacggtgtgatcaccggccacacgggcgcggtgggtcatatcttcttcgacaacctgacgcagatgaagaagggcgatgtcttccaggtgcgcgtcctggaccaccacttgtcttacaaaatcgaccagattcgtgtgatcatgcccaacgacgtgcacaacctgcagccggtggagggccgcaactacgtgaccctgctgacgtgcaccccctacggcatcaactcccaccgtctgattgtgcgcggccgttatataggtgacaacatccccggcaccccgcctcagggggcgcctaagtgggtgctctggatcttcctgctggccctgctgatcaccgcgctcctgatgcatctggtcactcggaagcggcggcagtgccgaatcgctatcgccttaatccatcgcaattacgggctgggcccgggcggcgatccaggcttggctggcggcttgccagggcctggctccccagggtcggcgttcatcggtccggccggcgtcgccccggctggtggccaaatgcccagggccccggccggccccgcatcactggctagatcatccttgcctgcgggagggtgggacgatgcttccgggccgggagcccctggttcgcgcatggaccagggcttctgaccgggctcaggccgcacgggccgctatagtatggtgagatatatctgggtgggcgggccggtagtcctgcccgctgccgcttcgtggggcaaggggtgtagttcagatgatatggaacgagcaaacgggccgggagggggaaccaactgtgaccggcgcggaaggcgggcaagaggagcgcagggccgccgatgcgttcgtggcccgtgccgccgccgtcgcttttgccgtcaaccgtcaccatcccggttcgggccgacgcaggtccagcgatggtgaggaacagccttcgtatctggaagtgcccaggctcaagctccagcaggtcgatgcggagccgcagcaagagtcccagtggtccggcgctgtccctgatgattccaacccggctctcggcctgtatggctcctaccccgagactcagcggcctgcgtcgcccggcactgtgcctcgtgtgagcccggagccctacgccccggctgttcctcccgacctggatgttcctgtgacagctgcgccgctgaacccagcgtcaacccagctgacgttgacggaagacagcccttggcggcccagccccgttccggtggttcccccaacgcctactgtttcccccgtccgcgcgccctccttccccaggcaggcatacaacccttacagcgctcagagtgttcagagcgcgcctgtgtcccccgttcagccctccttcggcgctacggccccgctggccccgtcttcgcggtccatcccggagcagtctgcgggccaagctcagacacctgtgtcggcgatcaattccgcgtattcgtctatggaagcccctcaaaccatgccattcacttcatccactccgtctgattctcctttgggtagtcagaccgccgccatcggttccggcgccccagcccagcggcagaggcaaaagccggagcaagagcgcaatcagtcagccgtctccaagccttcaggccgcaagcggggcggcgccagcgtgcccaagggccggcatacgcccgtctggagccggaagcgccccagcgacatcaaggccttgcgagcgagggagaggcgcctgaccgtgctctggtggattctggctgccctggccctcttcttcgcttgggcgtccttcggcctcatgatgcgaatcggcttcctgcctactttcgacctgggctactcctggttcgactcccacatcgccttcttcttcggcatcagtcccagcaattagcccagggattaggctggcccgtcgccggccctgacttagccggccgggcgtttccccgcccgggcccgcctcggcgaagcctctactcgcaagtgaaggacgcggtgcagaggcagcttggccatacgtcggcggcgatgacgttggacgtgtacgctgacctcttcgatgacgacctggattcggtcggcgagtccatgaatgacctgctgttggaaagtgcgctcaaagtgcgctcaaaaacaattaggagcgctgcgtagtttgccgcaatcctaatgattccaggggtttttgtaggggggaaagagtgcgaacggagggagttgaaccctcacgagcatgagctcactgccacctgaagacagcgcgtctaccattccgccacgttcgcaagcaatcagtaaatttaccacgcctctccacagcgcgcaagcctgccagaactcggccgtgtcgcgccggctgctcccggcgactgcccggcccaaaccccgcaggaggtcgctttcgctgcgggctttcaggcgctgggatcatgggcgttggctgttggcgcggtcgtagcggccctcagcctttggagccgtgagcgtagaagcgggcaagggtttcgcgcttgtagtcgtcgaagtagccgccgtcgatcgaggcgcggatttcatccaggagccgcacgaagaaacgctcattgtggatgctggccagggtcaggccgttgagctcgtgcgcatgcaagaggtggcagatgtaggcccgcgtgtagtgagtgcaggtgtagcagtcgcagtctgattcgatgggccggaagtcgtggcgcatgcaggcgcgcatgatgttccagcgtccgtcccgggtgaacacagcgccgttgcgcccgcagcgggcgggggagacgcagtcgaaggtgtcaccaccgttctcgaccccggcgaagatgtcgtccacggccgcgatgccgagcacgtgcctggggcgctcctccggcatttcgtcgcagatccaggcgcaggtctgtcccagcagccgcttctcgatggcgcccccgatgcccaccccgtcgaaggggagcgaggcgatttgcccggccgccctccgccgcaggtcctcatagttggccccctgcaccaccccaaagagcgcctggtacggcttatcggcgcggacctcggtcagtcgctcgtgctcggctacgcatcgttgggcccagcggtaggtgcgctcaacggattcctcctggtatgagcgggtgttcatcagcgtggtcagctcgtcgaaggagaacatgacgtcagcgccgattttatgctggattcccatggagatttcggcggagaaccggtggaggttgccgttcaaaggcgatttgaaagtcacgccatcctcgtccacgaaggcccgccgctcctttccgtcggcgattacctggtcggatttcaaaccggtcacatccatggccagggtctttttgaatccagcacccagcgaaagcacctggaaaccgccggagtcggtgaacgttgggcccgaccagttcataaagcgcccgagtccgccggcctcatcaagcacgtcctcgcctggtcgttcgaacaggtggaatgcattcgacagcagagcctgcgctcccaggtccttcatctgctcgggggggatgcctttcatcgccgcctgggtggccacaggtatgaaggcgggtgtgcggatgtcgccgtgtggcgtgtgaatgatgcctgttcgcccgtagcgtgccccgtcacgtccgagcccgtcggcggtgggggataggcgctgcgtggtttcaaagccaaaggtccctggattgctgctatagctcatgtccaaccactctaccgaggccccggtaggaggctctgattcgctgtgccgtatccgctttcggtgaatacatggcaggaccgatgacggcttccagttggtattcagacaacaatcagattgattgtctgtactgtaagcacagtgcaaaagttgcccctgtggtggccgaggcaagtataatcaacccggattgaacaataatgggtgagggtcccggttcggcaggcggatcgcaagctagcgtgaaggagcatcgatggcggacgacaataacatcaacccctggcagggtcaggatgatcagtcttggcaacccagccatatcgaagagggaaagaccgtggcctccgagtccgctgattcaaacgattcagacagtcacaatgattggcatcagtcaggccaggatgctgatgccaagggggagaccactcgcatcgagccaacccagccagtcctcccggtgactgaaccccagccgactgcgccggtggaggggcagcctctgccctctggtgctccggcagcatccggacccggtcagcaggtccctgcctatcgtccagctcccctgtatggtgcttatgcgcctgccggccagcaggctcagccccagcagaatcaggggcagccacagccggagaccggccaggactcgggtcaagcggaccaagctcagaataaaggcttcatcttcggtcagcggcccccggcgggccagcctcagcagccaaacggttacggtgctcccaacgctcccaacccttccggcccatacccgccggttggcggccaaccaggtcagttccagcctggaggggctcgccctctcgccccacagccgacgccgggccagccgcggtatgtcctgactgcggtcatagccgcggtcgtcgccgccgctttgatgctggccctaggttgggccgccatcaccaacggttgggtctcggtgcctaacgcttcctccctgggcgcggtctcctccgacacctctggacagggatcggccaaggtgccggatggcaaagcccccgattggcaagccgtggccaagacggtgtcgacttccgtggtctccatccaggtgcaggtcaatgacagcgtgggtgccgggtccggagcgattctggatgagcaaggtcatatcgtgaccaacaaccacgtggtctcgggcgcccagaaaatccaggtgacgctggctaatgggcaaatttactcggctcaggtggtgggtaccgattccacagccgacttggcggtcatcaagctggacaatcctcccaaggatttgaagccggctgaattcgcagattcaagcaagctcgccgtgggtgagaacgtcatggctattggcaacccgctgggttatgacaacacggcgaccaccggtattgtctccgccctggaccgtccggtttcggtcatggatgagtccggtggcacacccgtggtcacgaatgcgattcagctcgacgcggccattaacccaggcaactcgggaggccccacattcaatgtcgctggacaggttgtgggcatcaattcctcaatcgcctccactgccacttccaagtcccaggcaggttcaatcggtatcggtttcgccattccctccaacttggcaaagcgcatctcgaatgaaatcatcaaggacggcaaagtcaagcatgtggccttgggcatcacgattcagtccggcaccgcccaagcggacggcgtcacccgtggcggcgccaaagtgatgaaagtgacgtccggttcccccgctgataaggcaggcattaaggaaggcgacgtgattgtggctttcaatgatcatgcggtcaacaacaactattcgctgctaggctacgtccgggcggccgagtttggttcgcaggctaagattacggtggtgcgtagcggaaggacaatggatgtgaatgccacgctgaaccaggaggagcaggccgtcaacggcacgcccaagtctgattccaacgggcgcagcaagaaaaagcatgacgactctaatggcggttccgattcggatggctcgaacggttcggacggtggctccggcgacgatgatcccttcagtttcctcttcggcggacagtgatttcagtgtggtgacaggcggcggaagggctgcgggccgttgcggccaacgattctgacctctgcggttcgcggggcgatcaatccgggtgggaatccggttggtcgccccccccttcttttctcggcgacggcaagtgaggatcgggttgattctgggcgaagtgacaaggctggcatttggggctccgttgcgaagctgctagtattgcacacagattgtcagtgtaggcatgctcgcttcccagagtggtagcggcgtgcttcattctggcatccctgggtagaggctttgcgagtaagggcttcagtggggaccagggtatgtggggttgaaagtaggggaaaggtgtggtatgcgcaagcattcactgaggatgtggaccaacggcagggcctggttggtggcgatcctggcgtttgccgtggctctggcgatggtggttgcggttatgccgtcagcgcatgctgatacatccacatacacaacagatgatgacttcctgcctggtgacacgcccgattcaactcatccagcgaagctggtccttaccaagctgctcacctcgaagccgggattcaccgcaacgggatccatccaagacaagaccaactccaatatgcccgataaccaggttggcaagggcgtgcctttcaagctgacccagattactccgccgggcggcgcgcatcccggagacatgaaacccaatcaggagaacaccttcgttcgccgcacggagtatgtgggcatgaccgatgattctggtgttatccagaatggcggcagcggcataggtcactggcacacaagaagcgcgggaggttatacggacacgactagcttggcctccttccctcatggctattacctcttggaggaggtcacagggccaggcagcggcaacccttataccgatccgtccaatcccttgttcaacccccgatacactccagtcgagaaggcgatttacgatttgccttatcggtcaaccaacaccaccaccccaagccctggtggcacccccactccggttgagggcttcgtctataaccttcatatctatcccaagaacatcaatgacgcgcagctgatcaagcaagtcgtctcggtcaagaaacccaacggggcatcccgcgacaagaatgtcgcccaagtcggtgacacggtcacgtggaagataacccagaagctgtacgacgataatcacaccacgagcccgaatggtgatggcaggcttgatttaagcgaaataccggataccgcctcgaccgctgacgccctcgcgctggtggatgtattaccaacctcgttggacctcgtctcgggcagcgtccacgtcgcgctttcctggacggataataacgttgcccatcaacctgttacgactggattgccatccttcggcgatatcggacgttcgaatatgagtcgccctgtggcagggcattcccaagagtcgatggtggatccctccatgaggcctgatacgcagaagcagaatcgcctgttgagcttcgaggtaaaaaatggatcctctctcaagaccctttacgggaattacgtgtccggcaacacatacactgatattcaagtagccataacctatgacactaaagtgaccgccgagggcgacggggacgccggaccgatggggctcttaacgaatgtagctgtttcggacaacttggataattcaggctcaaacagcaaacccttcagcgtcgcggcttccgtggcttcgcctggtttccagttcgcgaagaccaataaggccgaagcgtcccatgtccctccgattacactggccggcgttcctggcgcggttttccggctaaccgacccctccgaccgaactcagttcctgtgcgacgatgcggccttccacaccgatacgcaaatcaactcctttggtggccgtgtcaaagccatcgaagccacgtccaacgagaacggtatcgtcactttcactggcatcccgatcgtcgatgatacggccaatgcggtttacagcgatgcatccaagttgaagttcggcatggtggagtacaagaaaccccagtactgcaccgctaactgcaacacgccctccccgacgatgaccgactatcttgccccgtcggctaacttcaagaccgttgatttctctagtctgagcggtaagccgatcgccgacctgcaagacacggaggtcaagccggacgtaagcaagctggatttcaaggattataagactccaagcatgcctacaggcaccacgtcgacattcaagaatatgcgcggtgacgtgattaccctgggcctgactaactggcagcaggatcaaactgatccggctaaggtcggagcgttgcctctgactggcggccggggcatcctcctgatgctgatcattggcctaatcatcatggtcattggtctggttgtctccaagcagcgagaacgccgcatggccgccaggggagcttactaggcctgacgtttacccgaatgcaatctaagccgtttccgcccccaggaagcggctttttccattttccagcgttccagtccgtgataatcccaaaccgctgaacaacgatgcaaacgcttccgaagagagtcacaagcaatggatcccaaatcggtgttgatggggaataatcgattcagaacgatatgaaccgatcaacaatgacatgagtcgttccgaaatgggactgactgtgaggaatggttttaggccaaattaaacgataagtagtgaagcgaatcggttgcctatcgcgatacatgggtgcaaatcggttgagtcggttgggagttgagggtgtttcgtgggggaggagggcttgccgcacggcagcggatggggaaggtgcataatgggaatcgtcgttgggttgtcgggcgttgaggcggccgacaacttctttatatgcggcggattcggccttgggcgcaaccatgtatatgaccgtggggtttgcggcgcgttggaggaattatgaaagaaggctgggcgtttgccaaacgagtgccgctgttgttggccaccattgcctgcggagtggccatggggttgctgtggcatgcccaccagcctgtggccctctggattgtgaccatactggttgccgtgaccctggtggataccctgcgaggcatgatagacgacgtgcgccacgggcatgtgggtgtggatatcctagccgtggtggccattctctccaccgtggccgtcaaggagtactgggcagcctgggccgtggtgctcatggtctactcgggagcggcgattgagcaatacgcgcagggcaaggcatcctccaacctgacggccttggtctcggccgccccccagctggcgcacatcgtcaacggatcgcaaggcaaggcggcggacctggcccgctctggcggcaaattgcaggaggccgattggtccaccaaaaccgtggaccaagtgcagctgggagatgtgctggtcgtcaaaccaggggagaccgtgcccgtcgatggcgaactgatatcaccctccgccacacttgacctgtccaacatcaacggcgaacccgtgcccaggcagatgttcgcttcagcccgactcatgtccggtgcggtcaacggctccggcaccttcctcatggaagccacccagctttcgcgcgactcccaataccaacggattctggagctggtgcgctccgcccagtcctcccgagcggccgtggtccgaactgcagacttgctggctgtgcctttcaccgtgctagccttcatcatcgcaggcgtggcatggattgtgtccggcgtgcccacccgcttcgcccaagtgctcgtgctggccactccctgcccgctgctgatcgccgcgccagtggcttatatggccggttcaggccggctggccaaggcaggagtcctgattaagacgcaagacgtgatcgagaatctgggcagggtgtcccatattttcttcgacaagacaggcacgctgaccgtcaagcgtccgcgcgtcacgcacgtggacaagccggcggctggcggaggcgcccaggccaccttggacgagcgccagattttggccatggctgggtctgtggaatcctactcagtgcacatcctgtccaatggcatctcggcggcgggtacgcaagcccagcgggagttgcaagaggaggccggaggcgcgcacttgagcttccgagctgagggcgtgtcggaggactcgggccagggtgtgcgcggtacagtgaacggacaccatgtgcgcgtgggccggttcgattacgtattggagacggggcaaggaggagggccctcacacccttccaatcatttcgccgacttggcggccgacgagatggccgcctatgtgtcgatcgatggacggctggcggcccgtattgtgatgaaggacgtgccccgggatgatgcggcgcaaacggtgcggcagctgcgcagcatgggtgtgaaccggctttccatgctgacgggcgacaagatggactcggcgcggttaatcgccgaccaggtgggaatccaagacgtgcatgccgggctctacccggaaggcaaggcggaaatcatagctgaagccgccaaactcaacccgggcaaacagccttggtgggacccctggctctcacgcttcctgggcgaatccgtgacccagtccattaccatgatggtgggagatggggtcaacgatgcgccggtgctggccgcagcggacgtggggcttgccatcaccgatggtacgacgaccgcagcgtccgagtcggctcaggcggtgatcatgaacgatgacatcgcctgcgtgccccgctccatcgccatcgctcgccgcactaaaagggtcatgctgcaagctgtggtagcgggtctgactctggccacggtcggcatggtgatggccgccttcggcctgattccagtggttatcggggccttcgcccaggagattatcgacgtgatttcgattctgtgggccctcaccgccctgatcgacaaggattgaacgccgccagcccaggcacacccgtggcggggggtgggctttgcgatagggtggagggcatgaacgacagcatgaatgagcatgattccaacgtgtccgggcgactgaaggtagctgtgataggggctggtccagctggcgtatacgcctccgacatcctcctgcgtcaactcaatcagaagggtgacgaactcggtttgggtgaagacgcacgtatcgatatcttcgagaagctgccagtgcccttcggcctggtccgctacggtgtggcgcctgaccaccccagcatcaaatacatagctggggctctggagaagaccctagccaaccccgacctgcatttgtacgcggatgtggagttcggcaaggatgtcagcttgggcgagctagaggaacggtacgacgcgattctgttcgccaccggtgccgtagccgatcggccgctggagattgaggggcacgacttgacgggggtgcatggggccgcgcgcttcgtcgagtggtacgacggttacccgaccgccccgcgcgactggcccctgcaggcccagcaggtggccgtaatcggcgggggaaacgtggctatggatgtggcgcggatgctgatgcgccgtgccgacgacctgctgcctaccgacattcccggtaatgtgtacgagggggtcaaggcgaacaaggcccgcgagctgcatatgttcatccggcgcgggcctgctcaggccaagttcgccgtgcaggagctgcgcgagcttgagaagctgcctggtgtgcagatagtgattgacgaagatgattttgaattggacgacgcaaccatcgaaaaagcgggcgacgataagctgacccggcagatggtgggcgagctctatgcgattcgcgacatggccgaggagatggcggccggcggaggtgtcgatttcgaagggaatccggccgaccgtaagtactgcatccacttttatcagatgcccgcggccatcatcggcaaggacggccaagtggctggcatacgggtggagcacacgcgcgtgaatccggatggggttatgagcgagactgggcgctacagcgaatacccggtccaggcggtctaccatgcgattggttacaagcccgccgaggtggccggcatcccctatgacttcaacgcttacacgctggccaaccaaggtggccgggtctgcacggctccggctagtgagggaggcgagccaatcgcccgcctctacgccacggggtgggccaagcgcggaccggtcgggctgatcggctccactaagtccgacgctctggagaccgtgtcgaacatgttggccgacttgtccaccagccctaaccacggccgtctggcgcccgaccgtgatgaggactcaatcgaccagctgctggccgccaagggcgtgcgccccatcgacttcgctggctggaagaaggtcgacgcctatgagcgcgccgagggcgctaaagccggccgcgaacacatcaaggtcaccgatcccgacctcctccgccacctggccctggactgatcactcggcgctcctgcaagcgccttgcaagccattgctggcatagccacctctggcatatacttgtcgttataagcgacggcccgtgtcagctgtctggaaagccgccattcttgcggcttcgcatcgtccgcgggctcaataaggagctgagtgatggctgagcttaccgtctacccggagacgctgcgctgggccacgcgcgttgccaaggcggacccgagtgcagtgtcgcggcacaagggattgcaggactttcccctctggctggaagcaactgaccccattaccgtatccttccagaaagttcatgacttggccgtcgttttgcagacgagtttcggtgccctggtgaggtcggcgctgccggatgagagcgaggacgaactggtccgctataggaccgtcggcaatgaaaccgtcgagcccagtaagaacttgctggacaccatttcgatgatgcgggcccggcagaactgggctcgggatgagctgatccaggacgggcttagcgaaaatgcgctggtcgggtcggtgtccggctcagcctctgatgaggacctggcccaggcgatactggatgctttgcgattagacgagcagtgggccaagggaaccggcgacgagagagtacgcttcaataagctgaaagagcgtgcatccgctgcggggttgatgatcatgcagaattcgcaagtggggcatcagcgccgaccgctcaacatcgaggaattccgggcttttgcattggtggacgacgtggcaccgctgattttcatcaatcggaacgattcgtatgccggtatgttgttctccctgctgcatgaaattgtgcatgtgctgttgggcgaaccagagatttatgacgatgccggtctgacccctgctggccgcgagattgagcggacaatcaatcgggccgtgatgaagagcgtattgagcgacgaggatttcgcggtcttgtggcgagagcagctggacgctgggctttctcggttggaagccgccaacgccataagccaagagtatggactgagcgcgctggctttcggaatccgcgctcggcaggcggatctggctgatgagcagttgatagagcagctgcgtgatcagatgcagcaggatttgcgcgccagggagcatgagcggcgaaagtcgagtggggggaatggaaatgcgactaacgcctcacgtctggatacaggctttgtgcggttggtgaagggcggcattgaaagcgggacgctcagctatacggacggattcggtttgttgaacatcaaatccgccaagtcctatgatggtctgctggcggccaaggggctgggctgatggcgcgactgtacttgcttgactccaatgtgttgattgactcccaccgccagcaccatccgttcatgtaccaggagtttcaccccttctggcggtggatggagaggctggccggtcgtgatgaggtgaagctgctggacgtggtgtataaggagctcactattcaggatacacaccacgatgtggatgagcttggggcctgggtggagtacgtgtttgccgggcgcgttgtcagccacaagacaagcgagatgggcgcggcttacgcgcgtgtgcaggattatctggtgcggtgcggttcttatacgcgcgactcaatccgggaatgggaacctgaagacaaggccgacccctggcttatcgcggcgggcatggttactggcgcggccatcgtgacgaacgaggtgagcgcgcatcccagtaggaaccagcggcaaaagcgcgaaccgaaaatacctgatgtggcgcgggcgttcggtgtggaaaccatgaacctccgggcgttttacgatgcgaacggtcgactcatcaggggcgattaccctatccagggccagatggcgctgtgatctcttcccccttccgccgtcccaagggccgctcgctctggggccctcagaatttcaaagggtgcgaagctgttcgctgaaatgctggtggtgggcctgcaaaacgccccccaatgccgagtgcctcgtataggccatacttaattcgggcatgcgaagagcatcaggactctcgttccgtcacgctctccgcttgtgagcgtgcgtttgtaccgccggtgtttgagcgctagaccatgacccgatggcgggtttggggagcttgggcggaggtggggattgcgcgtggctgaatgcgtggaggtcggctagagtgctgtgtatgaacggcaagctgaaagtgcatgggcactataacgggctgaagacgaccttgctctttgcagttatgtgggccatcatcatgctcatctggtggctgaccggcgcgcgctcgggcacgctcggcttctatatcctgattggcctgggcaccacgttcgtctcctactggttctccgaccgcatcgcaatcgcctccatgcgcgcgcaaccggtctccgagcaagaggcgcccgggctctaccggattgtccgagagctttcgcagcgcgccggcaaacccatgccgcgcatttacatagcgccgaccgattcccccaacgctttcgccactgggcgcaacgagcgccacgcggctgtgtgctgcacccagggcattctcaacatgctgaacgagcgggagattcgcggcgtactgggccacgagctcatgcatgtctacaatcacgacatcctgacttcggccgtcgcttcggctatggccacggtgatcacctacctggggtattcgctcatgtacttcggcgggggcaatgaccgcgaccgcaacccctccggcatcctggggctgctcggcgtggtcgcctcctcgattctggcgccgttgggcgcctccctgattcagatggcgatctcccgcacccgcgagtacgacgccgacgaggacggctcccggctgaccggggacccggaggcactggctatcgccttgcagaaaatcactgtgggcgtggagtatgatcctatgcccaagaccgctggcacccagtccgccgccgcgatgatgattgctaatcctttctcctccaagggattcagccagcttttctccacccatcccccgacagccgaccgcatagcccgcctcatgcaaatgtcccgggaaatgcaactgtcccaggccgcgggccaacaacccaccctctcccagcctagctaaccaccgtctggtaggccctcggcggttcgcggccggggcgctcagagcacgcggtggccggcggcgatgatggtttgaggggtgtaggtgagcgggtccaagagaaggagatcggcggcgtaagcgggggcgagcaggcccaggggcgcgccggtgatggtgttggggcggtccaggcccagggcgcgtgcgggggtcagggtggccgcttcgacagcttctggggcgctcaggccgatggcttgcaccgcccggcggacggccacgtccagggtgagcgtggagccggcgatggcaccgtttgagacgagacgggcgtggccatcccgtacctccacatcaagcgatcccagcttataggcgccgtcggggcagcctgtggcctccatcgcgtcggtgatgagcgcgattctgtgggggaagagatggaaggcgagccgtacaaccgggtcttgcacgtggaagccgtcgttgatgagctcggcggtcacgcgcgaatcctccaaggctgccggaatcggtcctggttcgcggtggtggatgccattcatggcgttgaagatgtgagtcaagacgcgggctccagcgtcgaaagcttgctgggttcgcgcgtagtcggcatcgcagtggcccacggcagggaccaccctggcgcccgccagtcgcccgatggcctccatgccgtgcgcgcgctccggggctatcgtcacctggcgaatgcaaccgtccgccgcctgcaagagctggtctaccgccgctggctctgggtcgcgcaggcaggctgggtcatgtgcgcccttgcgggccagggcgatgaacggaccctccaggtgggcgcccagaatgtctgaacggacactcatggcctggcgcacttcagccaggttggcgcacatcacgtctagcgggttcgtaatcaggctgagtacctgccgggtggtgccgtggaccatatgcccggcgcgggcggtgcggatggcctcggcgccgtcgtcaaaggaggactgccaggccccgtgggagtgaatgtcgatgaacccgggcgtcaggagccgaccgctggcattaatgaaagcgcagccgtccctttgctgggtcactggagcgccgggggtggggtttccgccgcaggcgcaggcgcttgcgtctgcattcgctcctgcgctttcgccggattctgcgccagccgatgccgctgcgacgggaacaggtggcagcccgagcccccgtagggctgagtccagcctggagcgtccctgacctacgctgtgaatcactccgcctgtggcgatgacccaggcttgcccgcgtcgtcctcgcgcgtcaacctgctccgcgtcatagatgacggtcggttgggcgggcgatcggaggacctgctcgattcgctcgccttcgctcctgaacgatgtgcttgtcatgatgtccgccctcctgcgcgtcccgccgattgcggcttgcgccgcccactgcctcggcgcgacagccctcatgcgggcctaccgcgccgaggctctgtttactccacggctacgccgacattcctattgtcctcggatattgtgcggcagatgctctcaggttcaagcgcccgcctcgcagccagggaacctcagatgccctgccaggcaggcttgttggcgtaggcccacttgtagtagtcgcggttacgtagccgggaggcggccgcctcgtcgatgatgaccgtggcgtgaggatgaagctggagggctgaggctgggcagaaggaggagatgccaccctccaccgtctctgcgaccgcttccgccttgccggcgccgaaagccaggaggattagctgccgggccttcaagatggtgccgatgccctgggtgatgcaatgggtgggcacctgattgatgtcgccgtcgaagaagcgggcgttgtcgatgcgggtctgttcggtcagcgttttgatgcgggtgcccgaagccagtgaggagccaggttcgttgaagccgatatgcccgtcggtcccgatgcccaggatctgcaggtccacgccgcccgcggccttgatggcctcatcgtactggcgtccggcctccgcgatggtcttcaagtcgccgttgggcacatgtaccttggctgggtccagtcctagcggctccacgacggtccgttcaatcgtcgatcggtaggactgggggtgggctgggtccagtcctgcgtattcatccagagcgaacccacgcacctgtaaaacgtctatgccctcgtcctgcactttggcggccagggcccggtaggcggccagggggcttgaaccggtggccaggcccagcacgcagtcaggcttggtttgaatgagccgggcggcgcagtcggcgtagatacggccagcttcgtcctcggttttggcgatgatcacttcggtcatgatgtgctccttacttggggtttgcgcatcccctgcgctcgctgtgtttacgttaatgggcaaggctggtcgggcccagcctttgattgggttatggctcttgctctgggcggatttgcggctcaggctctgggccgtggctggccttggggcttgcgccgggtcgctggcggctctgcgcggccccggctagcgctgctccaaccgcgccgatgcgttgattggaccccaccatccgcaggcgggccggcaggttcaggaatgagacgaaacggctggttttcccccgtgcggtcagctcagctttgaccaggtccaggagggcggggccggtcttggtcacgccaccgcccaggatgatggcatccgggtccagggtcgcccccgcaatctgcacggctgtcgctatgccggagatgaccgtgttcaaagcctcccgggcgtcagcctggcctgctttggctttctcgataatatcgggcaggggagggtcggcctgaggccaatgggcttggatggcggctccggaagccacggtttccaggcagccgtgctggccgcacttgcaaggcagggagtgagaatccactgggatatgcccgatttcaccagcgtaaccggtggcgccgtgcatgattctcccgtcttggatgatgctggaacctaagccggtgcccaagttgatgaagaccacgcagggcaggtcgagcccctgactggcgcccagggctgctgcgttcacgtcgttttcgaccaggactggcatgttcagggccgcttgggcctgcgctcctaggtccatccgccgtatggacaggttcacggcttcgctcaccaaacctcgggcactgtccaccaggccgggaatcccgattcccaggctggccgtggagggcgaggcctggtcggttcccctggcctgcctgatttgggtcaggagcgaatgggttacgttgaccacgtcttcgagcacggattgattgccttggtggctgtcctgccggcaaaaggcgacgacgcgatctgattcgtccagggctacgccttcgattttggtgccgcccacgtcgatgcccaggcgaaggcctggtttaatggttgccgtcgctttgcttgattggagcgcctccgtcatcgccgtccctccctcggttggcccgtctagagcgcctcggactgccgaaaccgctacttttctcagactagcaccaattagtaaactatctatactattttgcagcccgctacttccgggcctcgtggggcaggcttactgccgtttcgttggtgctggcggtgttgggcgaaatccccgctagctgctacactacgtaacgtgcgtccggctccgtcggtgtcaatccggctggccaagacagcacgcgggcgtagttcatcggtagaatggcagcttcccaagcttcagaggcgggttcgactcccgtcgcccgctctcggggaatcgttggaatctcaaggaagacaatccgtaagaacagctaatggtgtgcttatcccttctgaggtgtatgggaccttacggttgaggcattcgccgccaaaggggagcgtcgtggcacgaagcgcggatggagcagctgctcgcggctgtgtagagcataccataagtcgcccgatccgcccgtgctaaaaagttaaacctttcctcgctggcgtcggtgggggtcgcgcagcggcttggggccgtggtgggcgcgtcgccattccctttggctcccgcgaagccaagtccccggggtgaagtgtgccgtcagtgggtaaggcaatgacgtgaactcctttcgcgaggtggtttgtgatgctcactccgtccggcatgactattgtcgtcgtgatgaaggggttcgccgccttgcatgggttggtgtcggttgcggccggtaaaaagtaaggaggggtataggggcgagcgaatatggggggtgagggcattgggaacgcagggagaagcaggggaatccggcgacgagcggctggcggggcagcagcagccggccgagcaggaagcgcggcaggcgccggagatggttggccgtgagcaagcgcggccgcagcctatcgagcaaacgcgaccgcagtgcggggctcaagctgagccgcagcctatgcggcagccgacgcagtctgcacagcagtttggtcagccgactcagcaaggggcgcaattcgcccagcagccaactgcgcaattcgccggtcagccgacccagcaattcgcccaggagccggtggagccgccagcgccggcggctaagcccaggcgcagtccggtgccctggattatcggcggggtggcggtcgtggtggtactggcgttagggctcattctgcccaacctggagaccattggtatagtactggggctaggtcccaagaatccaatcgcggtgaccctggaatccttccgcaaactgccggacgcctcctcggcgcgaatcaaactgagcgtagggtcgggcgatgacttctccctggagggctactaccagctggggagctccaccgataagtcggtggcggacttcaccgtgaaggcggacgattaccgggggcggctgctgctgttggataacggcctgtacgccggcggggatggacagtacgtctacatggacggcttggatgtgcgctccgagctgcaggatgtggactttacctgtctgccggacaaaaccgatgcctccacctgctttgatggagactccctgctcgaattggagcagaacctgattcgtgacggacattggaacacaagcgccgcgcaaagcgagtttatgcgctcctccgagcggctgcacgccgcccataggggcgaactcaagcgagggaaggacaagaccaccgacacgcagccccaaatggacacgatacagcggcaagggcaggaagtgctgaccaggtttgtggcaaaaacgctggaagacaaggacacgcagggcaaggtgttccccgagcagagcagccaccgtgaggacagcggcagcaggttggaatacacgctagacaccgagcagctggtgcgcgtgttcagccggtacatgcttgattccaagggggactaccctgagttgcgcgcttatatcgacgaccagctaggctcagcggggggctcttatgacaagctgttctctgcgggcagccgttaccgggatggcggcgaagccgacgagaagcggctgccgataatcctgcgcctcaacagggacaggacgattaaatcgattcggtgtgacgccaagggcgggatgggctttgagcttgacgtatccgacgtgaaccgggtcaagacggatgacggcgatttggaagcgttcgcgcgcaaggcacgtgaggggcagtcgctcaagggattggggaagctgctgcgcagtttgggctcgaacgatggttggcggggccggtggggcggtgagtcggattctgattccgggttcggctccgactcggattcgggctcggacggggacgatccaggccaggacgattccaacgctgccagcagcgacctgcagcgttcggtctatagctcgatggctttattgcggtatcgtgggttggtatgagcatggacaatgatgacgagcctgtggctcccggcagtgtgggcgagcctcaacatgtggatatagtcaagtattcgcgcaaagatggccgttccaacccgcgccgtccgctctttctgctgctccacggctggggctccaacgaggaggacatagccgacctgatgcgctacgtggcgccgtacaacgactacgcctccctgcgcgcgtcaatgaccgtgcccggctccgagcgcggcatgttcggccctggttacacctggttccaccgctccttgccccagggcgaggacctggaccgggacggcctcgcggcggctacggccgtcgacgagtgggtgcgggccaacctgtccgacgagcgcgaagtggtgacgatgggattctcccagggaggtatgctggccgcccatctcctgcgcattaatccggagcgttaccgggcggcgatcagcctgtcaggtttcctggcgcccggcttggtccccgacagcgcgcctgcggacaataggctagcggacatggaaaaaccggtgttccacggttacggtaccgccgaccaggtggtggcgccctacgaggcgcgtgcttttgacgcttggctggacgagcacacctggctgcgctcgcgctcctacgacgggctggaccacgcggtcagccaggccgagctgagcgacatccgccagtggctctccgacatcgacgtgacgtccggcctcatgtaggagttcgtgccagaccccgtctccgccaggccttcacgcttacaccatcgagtcggtatccacctgcatcacgtacacgttgcggcgcaggtcgcgcgcctgcccgcgcgagatttcgcccgcttccaccatgtcttggatgactgagagctccaccgtgtagccctcgctcttgacttcctccaccgattcgcggatttttggcgtctcaccgaactcggtcctgccttcggcggaggattcgatcagctggtggttgatgatcgtggcgagcaggtcctcggtcttgtaccgacccttacccagctccgcgtacaactgctcgaccacgtggtggttcaggtcggcctggatctgccgccccgccaggaacacctcgttatcggagatcttgggtgtcacatgccgcagtcggtgaatcaggtgccgagccagcccttgcgcccggcgcacggctatgtgcaggtgccacttgaactcgctgccctggtccaggtgggccagcgagttggtgatgtggtccagaatcgtggaagcggcctgttcgcgcgattcctgggagtaagtgggctcctgctgcctgtccccgccgggttcggcgttgccgtgagcctcgccgtctgcgccctcgtggccatttcggccgccggattcgtctgatgccgcgctgttcctggtccgcgccccctttgccgtcatccccgcgggcccttgtgacgcagcgttttggctggccctgtcctcttcccgctggatgctgtcgagctcggcctccatgtagtcgcgttcccattgcagcgtctgcaattgcagggcctgcggctcttgcgggttgtaagcgccgatctgcgatttcatccgcgctatccgctggttgtacagcgtgatgacatgctgcactgccagccggttggagtcgtccgcccggctggacagctcctccaccgtccgtcgcagcacctcgatcgacttctcgactttgggcgcctcaggtccgttctccttggcgggcgccagcaggggcagcccgaagttggccagcaggagggtcacgatgatcactcctgccgccacgaatatcagctcgttgcgcatggggaagtccgcgcccgaggcgagcgtgtaggggatggtgagcaccagggagagcgtgatggtgcctttgggcccgcccagggtcatcaccgcggccgagcgcaggcggcgcttgttcatcggtatccgcttgccagtgccagggtcggtggcgaagtagagcaccccggccacccagacgaacctcactgcgattacggtgcaagacaccagcgcgatggcggccagcagggtggggttgcccacctttcgatccccccaggaagtcatgatcgccgagggcagcagtattccaaggatgatgaacaccgcgccattgagaccgaaggagagcaccttccataccgatgtggacacgatgttggttttggaggtgttgggacctactcccgtatggtcgaagcggatgagcagcccagtggccacgacggccagcacgcctgacacgtgcagccagttctgggcggccagataaatcaggaagggcaggaacagctccatcaagatgcgcgtggtcatcgactcccagcccaagcggcgtgcggtttcgaagacccagttagtcaccggccccatgatcgcgccgaaggcgatgccaccgatgaaggaggccaggaagctgcccagggcgtgtacgggcgagaaggcgccggtcacggcggtcaggatggcgaattggaagccgatgacgccggtggcgtcgttgaacagcgactcgccggccaagatggagcgctgccgtttgctcaagtcggcgtcttcgccgatcgaggagacggcgaccgcgtccgtgggtcccagcgccgcgcccaaagcgagcgctgctgccagcgggtacataggccagacggcgtgaagcagcaccccgaccatcagcatggtgaaggcggccaggccaatcgccagcgacagtgagaggttgaggcttttgagcagttcgggcttgtcgatcgtgtgcgcctcgtggtagagcaggggcgcaatgaagaggaccatgaacagctccgggtcgagctgcatgtgcgaaaactcaggaaggagggctagcgccgcccccagcgctatctgcaccaggggcgtggatatgcgcggcacgaaccggctcaggaaggatgagacgacgaccgccgccatgatggtgaggatgagcgtgaaaagttccacgtgccgcctttccgtcgctggcctcggagcctgaccgcgccgtgttgtcttgttgtatcccctcggtccgccggctggcgagcgtccgccccgggcgcgcgcgccatccgcggaccgggagcgcatccggctcacccgatgaggggacggctggtcaatgcgcgcaaggtccccgcacccgcccttataagcttgcagaatgctcttgtaaccattatatgaaggtgggaataagcattcagcgaattccgttgttccttctggtgcctcatataaggctaaatcagcgaaaccgaccatgcagaaaggccggcgaaaaaccatgccgaataacgtgactgagtcaatcaataaaactcgccagacagatacccgctcgaatgccccttcactggcctccgcagggagcgcccccagtgtccccgaccgcgcttcccagcccgccgggcaactcggcccggaccaggcgcaagcaagccaggacgccgcctggcacgccctgagcgtcagcgaatctctcgataccctcagcgcctcgcctgaggggctgtcaaccgccgaggccgggcggcggttggaattgttcggtcccaacgccctggcccagggcgaggccaaacccaagtggaagctcctcctgaagcagttcaccagcccgctgatcgccgtgctcatcgtgtgcggcgtaatcaccatctttttggggcattatgtggacgcgggcgccattttcctcgtgctcgtcctcaacgccatcatcggctacgtccaggagtccaaggcggacaaggcggtggaagcgctgacctccctggcctcgcccaccacaagggtgttgcgcgaaggctctgcggccacgatcgacgccgccgacctggtgcccggagacatcgtgttgcttgaatcaggcgaccgtgtccccgccgatttgcggctgattgacgccatccacctcaaaatcaatgagtccatgctcactggtgagagcgaggacgcccgcaaaggcaccgatgccgtggaagcgtccgctgccctgggtgacaggcgtaacatcgccttctccggcactatggtcacgtccgggcgcggtcagggtgtggtagtggcgaccggttccgacaccgagttgggcgaaatcaatgacttggtccatgcctccaaaggtttgacccctctgcagcgcatccttaagcgtactgagaccggcatcgccatcgcggtcatcctggtcgcggtcttcgtcttcatcggtggcgccatcatcgacggcgaccccgcccaggctttcctgtccgcggtctcactggtcgtggtgtccatgcccgaggctctgcccatcgtgcttacggtcgctatggctttgggcgtgtccaggatggcccaatacaacgccatcgtgcgctcgctgccggcagtggagaccctgggctcgatcaccgtcatcggctcggataagaccggcacgctcacccagaaccgtatgagcgtggagcagctggccatcggcgggtccgtcatgcatctggacgagctggagcccggttccaagcggaaccccgcggcacaagccttgctcaaggccggcgccctgaccaacgaggcccaacgctcgcgtaacggccaggggcagatcacctactcaggtgatgcggtcgatatggctatggctcgggcggccgacgaggccggcgcggtgagcgaggccgagttggactccgccatcgagtcgcaaaccccgtatgagcctgagctcctgcactcgatgaccatccgccgcaatcccgacggcagcctgacccagtacgtcaaaggcgcgcctgatgcggtcatggccatgtgcgtgggcatgcagaacgcctccggccagtccgtcccgctggatgccgccgctttgcacgaggcctatgatgagatgggcggccaaggtttgcgggtgattggcgtggccagccgcaccatcccggcttccgacgatttgagcgcccataagaaggctcatgatatgaccttcctgggtcttgaaggcatgctggacccgccgcgcgagggcgtgcgcgaggccatcgccgactgcgcccgcgccggcatccgcgtcatcatgatcaccggcgaccacccggtcaccgccgccgccatcggccgtcgcttgggcttggagtccaccggcagcgccttgactggctccgagatgctcggcatgagcgatgaggtgctggccgcccgtctgcgcgagacctcaatcgccgcccgggtctcgccccaagataagctgcgcatcgtcgagaccctgcaagaccagggggaggtggtggctgtcaccggcgatggggtcaacgacgcaccggccctcaaagccgcctcggtgggcatcgccatgggcgagtccggcaccgacgtggcacgcgaggccgccgacgtggtgctgaccgacgacaactttgtcacaataacccaagccgtgcgccagggccgcgtcaccttcaaggccatccgtggttccgcctacttcctgctgtccacggccgccgccatgatcgcggtgggcgtcaatgtgatcgccgacatgcccctgctcttcctgcctttgcagatgctctggatcaacttcgtcaccaacggtgtccaggacatcgccctgggcttcgaacccggcgatggcgacgagctgacggtcccgccccgctccagcgatgagggcctgctctcccgggtcctgtggtcgcgcgtggcggtctgcggcctgtggatggccacctgcgtgctgattctcttccatgtcatcgtctcgtccggcatggacctgctccaggcccgtaccctggccctgaccttgctggtgctattcaacttctttgtggccatgtccgcccgctcggagaccaagctgatcgtccagctcaacccgttggacaacaagttcctcctgctggcttccctgctggccctgggcatccacgccggcgccatgtactggccggctttggcgggggtcctgggcttcgcgccgctgaccttgtcccagtggggcctgtgcctggtggtcgggctgaccgtcctgatcttctcggaaggcgacaagctgattcgccagctcctggcccggcacggtcacagcccgcgttcggccctgcgccacacccgccgttccatcgccgccatgttgcgttccagccgctgagtccgaggaaccccgccgcgcatagtcaacagccagtattgcggcgagcgatacggcgagcgccagggcgggcataactcaaccagcgaggcgtcgtcccccggggcggcgcctttgccttacccaagccccctgtgccacactggtggggtggaagattccggtatgaccatcccctggcgcgcccccatgcagggcgccttgcgggaggctgcgctcgcccaggcggccggcgacgtgccagtcggcgctgtcgtcctcggccctgatggcagcgtcctgtcccgtggccacaatcttcgccaggctcagggcgatccgttggcccacgccgaggtggaggccttgcgcgcggccggctcctggaacctgtcggattgcacgctcgtcgtcacgcttgaaccctgccccatgtgtgctggcgccgcgctcgccgcccatgtgggccgtatcgtcttcggtgcctgggatcccaagatgggagcctgcggttcggtctgggacctgccccgcgacccgcacgtcggcgcccgccccgaggtggtcggtggcgtcgaggaggccgcctgcaccgccttgctcgctggttttttcgcagcccggcgttaaccccccccccctggattcgccctgctatcggcgccttgcgttgcaccggcctcccggttccccacctcccgtttcctcgctattgcccaccccctagccaaggcgtgtccaccatctggacaacggcgtccgcgcccctgccctttccggcatactgccatataaccgtcgggtctctcagcgtggcgtatccattccggccgcgcgcccgtcggcaggctcgctcaagcggcctgggtctcacgaaaggggcggaacgatgaagtatacgatgatcggcgctggcgcgatggggtatcggtacggcgttctgctgcaggagaaggtgggtgtccaggtcgattacatcgatacctggcagcccaatatcgacgcggttcgccagcagggcggcgtctacgcctcccgcgaccacgaggaccgccacctggtcccgatcaacatctacacgccggaggaatacgagggcgacccggacgtgtggatgatcttcatgaagcagatgcagctggaagagatgctcaagcgctgcgctcacctgttcaaggaccatcaggtcgtcttctccgccatgaatggttggggtcatttcgagaagatcaaccagtacttccccgcggaccgcatctatggcggcacggctctggtggcgacggtcctcaacggtccaggcgacgtggacttcatgggcaaggcgggcgccggctccatggagatgtgcgcgatgaatgagcagatcaccgacgttgagaaggccatggccgcggactttgacaaggccggtttcaaccccacggtcacccggaatttccacgggacctgcctggcgaagatcatcttcaattcggtggcgaacaccctgtgcactatgtaccagattcgcatgggccagttcatctccttccccggcgccatgaagatgactgcgcagctggtcaacgaggcctacgatgcttgcgagcgcgccggttaccagatgacccgctcccggcaggaagagatcaaggcgattgagatttccagccgtgagactaaccccctgcactacccgtccatgtatcaggatctgaccaacgggcgccccaccgaaatcgattacatcaacggctacatagctgagctgggccgtgagaacgactatgtatgccgcacccacgagttcgtggtccagggcgttcatctcgctgagctggccttccagattcaccaaaaggaggccaaggactagacggcaatgactgagggccgacctggccctaggccgtgtcttcataggcgaatatcccctccggcggtagaatcggaagcaggtggggacgttcgcctttctcatatccagggtcgcgtcccgcacgatgagccggcgggcttgggcgcttactggagagcgcatggactggtcggcgtgagaggggttgtgatgtcacgtctgattatcgtctcgaaccggctgcccgcttcgctggaggcttcggcggacggttcatactccttgcggcagaacgtgggcggtctggccaccgccatcggcccctaccacaaggcccaccgtgactgcctgtggatcggctggtccggcatcgaccctgaccagtatacggatgaggagctcgagaagatccgtcaggcttaccgggaccgccgctgcatccctattttcctgagcgatgaggagattaacggctactacgccggcttttccaacaacaccctgtggccgctcttccacgatttctctcacgaggcgcaattcaatccagacgactgggagacctaccgcaaggtgaacatgcgtttcgcccaggtgatcgagcccctggtcctgcctggcgacacgatttgggtccaggactaccatctgatgctcctgcccaagatgctgcgcgagcgctatcccaaggcttcaattggctggttcctgcatgtccccttcccctcggcggagattttccgctccctgccctggtgccgggagattctggagggtgtgctgggcgccgatttggtgggtttccacaccactgatttcgtcatgagcttcctggcttccatctaccggctcctgcctgagttgactgtcgaccaggatggtttggtccacatgccggatggtcaccgggcagctgtggacgctttcccgattggcatcgactacaacctctacgcccgcacggcccgctcctccctggctcgggccatgcgccggggcattgaggagtccgccggcaagaacaccgggcaccgctaccgttcctccgtgacggccgagggcgacgccgccgccgaagccggcgatagggacgccacctggtggagccagcataagctggaggacctgcccgaactcaccttggcccgttcggccgcttcgtcaatcggccgcaaggagaacaaggtcatcgtctcggtggaccgcctggactacactaaaggcctgcccgaacggctgaaggccttcggtcgcatgttggagaagtaccctgagtggaccggtcacgtcacctactacctgctggccaccccctcccgcgaggacgtggagtcgtaccggcggctgaaatcccaagtggatgagctggtcggacagatcaatgggcgctactccctgctcgcttggaaccccatccactacatcacccgttccctctcaatcaagccgatttgcgggatttacgcggctggcgacgtggctctggtcacccccctgcgagatggcatgaacttggtggccaaggagtatctggcatgccacgacggccgtgagggcgctctggtcctgtccgacatgtgcggtgccgccgacgagttgaccgatgccttcatcgtcaacccctacgacatcgatatggtttgcgaggcgctccacgacgctttggagatcagcccggacgagtcccgggcccgcaatatgcgcatgcaggcccggctgaaggtgcgcaccgcctccaattggtgcacgagcttcttgaacattttacgccaggtcaccacgtcgggcatgagcgacaagcgcttgcggacgggtttgcgtaatgagatggtggactcctggcagaaagctagccgccggctgatcctgtgcgactacgacggcacgctgaccccattggtgcgtaaccccgatcgggccaagccgaccaaggccctacgccggattctgcgccaggtgggctcgcaaccgggtgtggatctcttcctggtctccggccgcagccacacgaccatggaggagtggttcgctgatttaccggttggcctaatcgcggagcatggcgcgtggagcaagccgattgagcgctcggattccggccccagccagtggaggagggctccgggcctgccggtggctgagcagtggcagccgatggtcgagccgatcatggaggagtccgtccaacgggtgcccgggtctttcatagaggtcaagtcggatgccttggcttggcattaccgcaagagcgaccccaagcaggccgaggccgagcgcgacgacttagccgcccgactcagcgccgcagtcgcaggcaagggtctgatggtgatgcgcaattccaaggttttggaggtctccccggtggccaccagcaaggggcaggccgtcttgccgtggatcaccagcggcgattatgacttcgtgctctccctgggggatgacgccaccgatgagaccatgttcgcggtcatgcctgattcggcttggtcggtaaaggtcggcccaggggtcactaaggcccgggcgcgcctgcttgatcccgccgctgtccgctaccttctgctcgatttggccgccggcacggcttcgggagccgaacccaagacccgcacggctggcgtccccggcagcttcgcccgcggcgagtcgtgataccggactacccgcgtttgcagcgcccagcccgactcagcgctgtcgcttgcttcgcgtgatcgtctcgtcgaccagttcaggcagggcgtcttggatgggtccgcgaatcaaccgctgggccagcccgtcgtactgggtgcgccccatgttcatgatggtgatcggcacctctgcttgggctgcggcgggcacgagcgaggccgccgggaagacctcaagcgtcgagccgatcacccagagctcgtcggcgcgcctgacttccttgaggctcttctccatggccccgtccggcagcgcctccccgaagtagaccacgtcggtcttgatgatgcccccgcagggcaagtccccctggtagggcagcggacgccggcagtgagggtcgggctcctggtcgagccggtccatgatttcactggtccggtaagcggccccgcacttcatgcagtgtgagctgccgatggtcccgtgcaggttgacgatcagctcgggtgagttgccggctttctcgtgcagggcatcgaagttctgcgtggccagcagggtcagcgttcctgcttcttcgagcttgaccagcgcacggtgggccacgccaggctgcgcggtccaaaccggcgattccttctgccagcgccaggagtattcacgggcgcgcttgttcgtcaggaaggcgtccaagtcgtagacctgcatctgatcgggatgcttggtccacacgccgtcgggcccgcggaagtcgggtatgcctgcggaagttgagatgccggctccggtcagcacggctattcgttttgttctcgtatttgtgctcatgtccccgtcttaccatgctcgacgcgccgggcgcgaaggtttttcgtcatgtggtcgaatgtgcccgggtgggaaagtgccttgaaatcgtctggtatcggtaaatcgacacgccgattcatcgccggtataacagtgttttgggcacttgtgaaagtcaacggtttgcgtttttcggcattcttcggtaagtttatctcttgccgcttggcgcgatgaattccactccttggttttctcttctgcgccaatgcaactgtggtttgagaactcaatagtgtgtttgtactgcttatagttttttgattgtcagtctgatgcctgcctggcgtgtttgcgttgggtgcgtgggagcgcttaattggtgtcgggtttttttgtgtgggccttccattggaccgtttggtttggtggttggcttttttgtcagttttgtattggggcttgtttctgccctttcattttttttgtggagggtttgattctggctcaggatgaacgctggcggcgtgcttaacacatgcaagtcgaacgggatccaagcagcttgctgtttggtgagagtggcgaacgggtgagtaatgcgtgactaacctgccctgtactttggaatagctcctggaaacgggtggtaatgccgaatgctccgcgctatcgcatggtggcgtgggaaagggtttctggtatgggatggggtcgcgtcctatcagcttgttggtggggtgatggcctaccaaggcttcgacgggtagccggcctgagagggtgaccggccacattgggactgagatacggcccagactcctacgggaggcagcagtggggaatattgcacaatgggcgcaagcctgatgcagcgacgccgcgtgcgggatgacggccttcgggttgtaaaccgcttttagcagggagcaagccttcgggtgagtgtacttgttgaataagcgccggctaactacgtgccagcagccgcggtaatacgtagggcgcaagcgttatccggatttattgggcgtaaagggctcgtaggcggtttgtcgcgtctggtgtgaaagtccactgcttaacggtggatcggcgccgggtacgggcaggctggagtgcggcaggggagactggaattcccggtgtaacggtggaatgtgtagatatcgggaagaacaccgatggcgaaggcaggtctctgggccgtcactgacgctgaggagcgaaagcgtggggagcgaacaggattagataccctggtagtccacgccgtaaacggtggatgctggatgtggggcccgttccgcgggttccgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcccgacggtcgcggagacgcggcttcccttcggggcgggttcacaggtggtgcatggtcgtcgtcagctcgtgtcgtgagatgttgggttaagtcccgcaacgagcgcaaccctcgcctcgtgttgccagcgggtagtgccgggaactcacgagggaccgccggggttaacccggaggaaggtggggatgacgtcagatcatcatgccccttacgtccagggcttcacgcatgctacaatggccggtacagcgggatgcgacatggcgacatggagcggatccctgaaaaccggtctcagttcggatcggagcctgcaacccggctccgtgaaggcggagtcgctagtaatcgcggatcagcaacgccgcggtgaatgcgttcccgggccttgtacacaccgcccgtcaagtcatgaaagtgggtagcgcccgaagccggtggcccaaccagttcgctggggggagccgtctaaggtgggacccgtgattgggactaagtcgtaacaaggtagccgtaccggaaggtgcggctggatcacctcctttctacggagatttcttggaatcctcgcgttgtttgacgtggggtcgtggccctggcggccgccgttgggcgggcgcgcgtgggctgttccactggtgcggaagcgatcatcgctgtgggtggtatgggcatgctgttgggttcccgggccgctgttcgcggcgcctgggcgccatccatggctggctggcccttcgtgggtcgtgtcggcggtggcgtggtggtggcttgagaactggatagtggacgcgagcgatcatggctggccgttggctggtcgtggttgctgcatgtttttcgccgggcctctgttgttcaggggtctggttgatcgtttgatgtgtttttgtgatcttgattgtgttgatgtgtcgtctggtaggctgtgcgccgcgtcgtggtcccgggggttcgcccttgggggtcgcgtcgttggtaagggcgtatggtggatgccttggcagacaggaccgatgaagggcgtatggggctgcgataagcctcggggagccgccgacagggctttgatccgaggatttccgaatggggtaacccgccggccgtcatgggccggcaccgtttttgaacggggggtacgcagggaagtgaaacatctcagtacctgcaggaagagatattccgtgagtagtggcgagcgaaagcggatgatggctaaacctttgccgtgtgatacccgtcgggggttgcggtaggggtgttgtgggacgttccgtccaggggccggcgaccctgggggcagtgataaagccgcgtgtgaggcgaacaggattgaatgcctggccgtagagggtgatggccccgtagccgtcagcgcgtggcctgcttgtgggcgctcccgagtagcgcgggactcgtggaatcccgtgtgaatccgcaccgaccgtggtgtaagcctgaatatgcctgtctgaccgatagcgaacgagtaccgtgagggaaaggtgaaaagcaccccgggaggggagtgaaatagtttctgaaaccgtgcgcttacaatccgtcggagcctggggtttgccctgggtgacggcgtgcctatcgaaaaatgagtctgcgagtcagtggtgcgtggcgaggctaacccgtgtggggcagccgtagcgaaagcgagtctgaaaaggcgtttttcagtcgcgcgccctggacccgaagcgggatgatctagccctgagcaggttgaagcgcgggtaaggccgcgtggaggaccgaacccacttaggttgaaaactgaggggatgacttggggttaggggtgaaaggccaatcaaattccgtgatagctggttctctccgaaatgcattttggtgcagcgtcgcgtgagtgtctgccgggggtagagctaccggatgcctgagggcccttgctgggtaccgagggcagccgaactccgaataccggtcaggtgtatcgcggcagtgagtcggcgggggataagctccgtcgtcgaaagggagacagcccagatcgtcgtttaaggtccctaagcgcgtgctaagtgggaaaggatgtggagtcgcatagacagccaggaggttggctcagaagcagccatccttgaaagagtgcgtaacagctcactggtctagtggctccgcgccgacaatgtagcggggcttaagcacgccaccgaagacgcggcagcgcgttcgtcgcgctgggtaggagagcgttccgcggggggtgaagcggccgggtgaccgggccgtggaccgcgcggaagcgagaatgcagacatgagtagcgagaggcgggttggaatcccgcccgctggatgaccaagggttccagggcaacgttcgtcgtccctgggtgagtcgggtcctaaggcgaggccgacaggcgtagtcgaatggatgaacgagttgatagtctcgtaccggcgtgagcgcgtcaggcttgaaccgtcgatgctgtgtccttcatcggccgggcggccgctttcgggcggttcgccgggttggtggttcatggcgggggcggggatggcagcgcgggagcgacgcgatgggatagccgggccgcggcggtggtagtccgtggttaagcgtgtggcgcgccaggcaggcaaatccgcctggcatgagcgtgaggcgtgatgatggggggtcttgtgccccgaatccggtgtgtcctgtcgcctagaaaacctccggcgtgagttctcatgccgcccgtacccgaaaccgacacaggtggtcaggtagagcataccaaagcgatcgagcgaatcctggtcaaggaactcggcaaattgctcccgtgccttcggcataagggaggccccgggcggtgaagagacttgctctcggagcggtttggggcggcacaggccagggggtagcgactgtttaccaaaaacacaggtgcatgcgaaggcgtaagccgctgtatatgcactgacgcctgcccggtgccggaaggttaagaggatccgtcagcccgttcgcgggcgaagcggtgaattcaagccccggtaaacggcggtggtaactataaccatcctaaggtagcgaaattccttgtcgggtaagttccgacctgcacgaatggcgtaacgacttccccactgtctcgaccaggagctcggcgaaattgcagtacgagtaaagatgctcgttaagcgcagaaggacgaaaagaccccgggacctttactataccttggtattggcgttaggcaacgactgtgtaggataggcgggaggcttcgaagcatgggcgccagcccgtgtggagccgtgatgtgaaataccgctctgttgttgtctggcttctaacctcggccagtgatcctggtcagggacagtgcctggcgggtagtttaactggggcggttgcctcctaaagagtaacggaggcgctcaatggttccctcagcccggttggcaatcgggtttcgagtgtaatcgcacaagggagcttgactgcgagagcgacggctcgagcagggacgaaagtcggagatagtgatccggtgccggcgcacgggcgcggcatcgctcaacggataaaaggtaccccggggataacaggctgatcattcccaagagtccatatcgacgggatggtttggcacctcgatgtcggctcgtcgcatcctggggctggagcaggtcccaagggttcggccgttcgccgattaaagcggcacgcgagctgggttcagaacgtcgtgagacagtttggtctctatcctctgcgctcgttggaatcttgaggagacctgcccatagtacgagaggacctgggtggacgaacctctggtatgccggttgtcacgccagtggcacggccggttggctacgttcggatgggataaccgctgaaagcatctaagcgggaagccccctccaagataaggattccatgcgccttcgaggcgcgggaggccccacgcagaacacgtggttgataggccggaggtggacaccccgtaaggggcggagccgaccggtactaacggccgatgacgacacgatcacgcccttgccgtgtggtgggggtcgtggcgtggcgtgagcttgccgtgacggacggccttcaacgggtcagggtccggcgcttcaagcgatcatgaggaacacgcgtccgctagccggtccccgagccagcaccaagcatccccgtcaacgcgggggtggttcatggattgttgtttgttttgcggtggtcatagcctgggggagacgcccggtcccattccgaacccggaagctaagacccagcacggcgatggtactgcactcggtagggtgtgggagagtagcgcaccgccgcaacacaaacgttcgagagccccggcaagcaccacgcttcccggggctctcaccacacccacagaaaattgtataaacccttatatgtcaatgttccggtatctgaggtgatatggtccatctggaagagatcaccaaggagaacttttaccaggtgattgagctgaagcggcccaaagaagagccctatgtcgccagcaatgtcctttcgcttgcagaggcctggttgtataggaacgacggccaggtgaggcctcaagccatttatgcggacgatacattggtgggattcactatgacttatgacgagctggatcggcctgtgcggagcttatggcgcattctgataccggaagaatatacgaataaggggtacggcagccaagccttgaaactgatactggccgaggcccgggagcagggtggtcttgaaaaggtggagttgagctatgtgccaggcaatacgatggctgaacatgtctatgagcaagtaggttttcgggctaacgggcggattgatgacggcgaagtggtgatggaatacactttatgagcccacacattcagcggtgttggctacaataggttcgcattcgcacagagaggggcatgggcgtccaatgcattacttcgttccaaaacgctgcgcgttcacctccaaaatcatgtaccacgacaagctcgcggccgaacgggcggctgagcgaagccagctggagcgcagcgtggacctgtgggtataccgctgccaggactgcggctgctggcacctgaccagccatgagccaggaagataccttggcggacctttcgccagagggcaaggccataggcactcccgtaagcgtggctacaaaccccgccagcgaaaatgagtacgtgccggaccaggaataacattcacccagtagtagagaacagggtgaaggcgacgtgagaagaaaagataacatgatgaatgtttagtaacttgaaatggaaacgttaccagtatatgatgttaatcagctctgatagcagaggtgcaacaaggtattatccctacagtactgtgggttgccgcgtctaatcagagttgatttggtaacgatgctaaaaggaaggtattgggcaataatgtcttcgctgaaatggggtaatagcgaactggagttagagttcggtattgcttcgacgcgcccagtcgtcattcgttccgtgaccatgctttccgccgcgcggcattcgacatctgctattggggaaaccattgatgccaacacgaatctgggtgccggtgggggaaatgaatcgacggaaaccaaggtggtttttgagcggccaatgccggtggtagagctcatggccgcacagcgaggcagtgggcacaccaaatgcagcagacggttgattgagacatcgctgggcgcgtctctcagatacaccggcgctgtgaagaaacatactgatgacgcggatatgctgactatatcaatggacagcgaactggggttggctgtaaacctgagttttgagctgccggcgggttgcaccatgatgcgggtgacagcagaggtgacgaatacgattgacgcgccgctggtactggaatccttggctgtatgctgtctaccgttcggagtgcgagcccatagcggtggtgagaaaagcaccgacctgctggacggctgggccctcacagaatgcgccgcagattggctaggcgaaggtcgctgggccacgaaccccatgcggcggttgtgcccggccctcggcaatgacctggtggggcggaatccgcaaggggcacactcggtcgtctcggaaggtacgttctcgacgggcacctcgatgcctatggggattgtgagcaaccagggggaaggcatagcctggctcttccaggtggagcacaacggagcctggcgctgggaagtcggtgagagggaagacaaggaggggtacctggccctcagtggtcccacttaccgcgaccatggctggtccacaaccctgatgaagggatgcagcttcacttcggtacctgtttcagtggctttggggcacaacgtggatgatgtgatcgccagcgttacccggtaccgccgaatggagcattctgcccttgatgagataggacgccccgggattattttcaatgattatatgaatacgctgaacggcgatcctacccgggacaagcttatgccgctagtggaggctgccgcacaggtcggcgcggaagtattctgcatcgacgccggctggtacgacgacaccggcgattggtggccttccgtgggcgagtggatgccctccagcaagcgcttccccaacggactatccgaggtaaccgacgctatccgagagcgtgggatggtgccgggcttatggatggagcctgaggtgattggcgtgaagagcccgctagccgctgaactgccggacgaggcgttcttcttgcacgccgggcagcgggttgtggaacaagagcgctacctgctggatttcaggaacccggtcgtgatagagcgaatgaatggcgtagtggaccgcctgattaaacagttcggcgtggggtatttcaaattcgactacaacgtgatgcccggtcccggcacaacctacaaggctgatagtccaggagatggcctgctgggtcacaaccgggcttatagcgcttggatacaggggctacaccgcagacatccgaacctgatattagagaactgctcgtcggggggcatgagggaggactttgcgcagacagcgcttttccgcctcaactccacctccgaccagcaggacttccgtaaatatccaaccatcacggctaccgcgccattggcgatgctgccggagcaagcagggaactgggcgtatccatcggccgagatggacgatgaggaattcgtttttgcgctggtgaacaccatgcccggacacttcttcatgtccggctacctcaaccgcttctccgaccggcagattgaactagtcaaggtggccgttgcggcctaccgtgagagcatccagccggtcatcacccaagctgttcctttctggccattagggctgccccagtgggaggacaagagcgtggctttggggctggactgtggcggtggccgagcactgctgacggtgtgggcccgctgctgtgaggaaggccggttgagcgtgccgctgccgaagtggcgaggcaaagcctgtgaagttcggccggtcttccctgcttttgatactcgagaatctgggatgcaggcttggtcctgcaactgggacgaagaaggaggtgaactcaagctagagctgccgaaaggcatctacacggctcggatatatgaaatatcggtgcgctgataatcactgcgccggttaaggggcggcggtgcagtccgcagcgggtatccgcccgggctgctcgctgataattggaagatacattcgagaaagggataacgatgacgttaatccacaagagcactagcaagcgcgggacggccagagtcatacggctgctggcggcagtaactgcggcaggactgggtgtttcactgatggcgggctgcggcaatcctgcatcaagcgcggacgataccgacacttcagcatcgggatactggccagcagcccagcagaagcttggcggagtgaccctcaagttctggacctcacctcaggcgaacaagatccccgcccaagtaattaaggattttgagaaggctactggcgccaaggtcgatctgataacgattcccgaggtctacgagaacaacgcacaaactaaaatcaccaccggtgatgtgccggacttgggcttctggcagcccaccaggtccatgcttgctggtttcgtggctcagggcaagctccagaaactggacaacgctccattcgagaagaactacaagccaggtattgacgatcaggcgggtctgtacaacaagacccgttatgctgtgatggtgagcgccccatcgaccatgggcgtttactataacaaggatgtgttcaagtctgcgggcgtggatgaaacaccacagaattggaacgagttcgtgcagactgcggagcacatcaaggatgccgatgtgcctggggtgcagtcgccgctgtttgagatgggcggttcacagtgggggactcagtgggccgtgcaggtccagctggcagaggcagccaaagccgggctgtgggatcgggtgaactccggcaaggagaagttcaccgataagaccatcatggaggccatcaccaactaccaggacctgtttaagaagggcctatataacgcggacgctggttcagctaaggacacagcccaggagcaggcgctgtgggacggcaagacctcgatgatattcggcaacaccagccaattcatggctgttgctgcgctcgccggcaacgacaaggcacagttggaccagaagattgggtacttccccatctccaaggacggcaactacactacgacgattcccgatgggtccaacggcgtggtggccttcaaaaccggagacagtaagcgtgaggcggccgctcgtcagttcatcaacttctggatgagcgacgggtacgaggcattcatcaagcaacaaaataacatctcagtgttcaagaacgtggaatcgcccagcacagtgccgcaggcggctctggacgcgtccaagtccatccagcacagcgtcggctccatgcagttgcaggcgctagctaaccctgacttatacgtgaacctggccagcatggtcaacggtacgatgacgccgcagcaagtggcgcagactacccaggaccagttcgcccaggtggcgaaggcccaaggagccaagggcttctaggctgaccggcgggcggcatcgctcttcccggccgtcgcccgctttgcccctctccccaggatcgttgacggagacgagcactgcatttatggatttaacagaaaggagctgcgatgtctgagccagtaacagcggccggccgcggttcatccgcagagagcggagctgcgtctgcgggcgcccttgaacgcgggcagaagctgggcggggcactcgggtcaggttccgccaggagcggccgggtgcgcgacaacgtcgtgctgaaaaagaactatccgctgcgatttctggttcccgctgcggcggtgctgatgatgttcttcttcgtgccgaccgtgctcaacttcatctacgcgtttaccgattggtcagctttcaagacgactatatccttcaatgggctcgacaacttcctgagtctgttcaataacggtatactgctgcgagatttgcgcattacgttaatgtttgccgtgtgcgtggcattcttccagaatgtgttcggcctgattctggcggtcctgctggaaagggacaccaccgagaaccgtatagcccgggtgctcttcttcgtcccggtgctcatgtccgctttggccgtcggctacgtctggcaggctattctgcaggccaacggcgccctggaccagattctgagcttcttcgcagggcacgcaatcagcacggcttggttgggcagcaccacctggtccatcgtcattgtctccgccatccaaggctggaaatgggcgggtctggccatgctcatctatttgtctggactcaagaccattgacgaggacatattggaggcggcgaggatggacggcgcgaacgagtggcaggttttttggaaaatcaagttcccgttgctggctcccgcgctcaccttcaatgtggccacatccctgttaggttcgatgaatggttttgatactgtgcaggcaactactgcgggcggccccggcggatctactgaaattctgaatttatttgtgtggaggaccttcgggcagggactctattcgcagtcgaccatgatgagtctgctgctcttcctgaccgtgatggttatcgcaataccgctcatctggtatttgcgtaggagagaggcgaaaatcctatgacgaacgcgagttttgaggcgagtaaaattaattccggcggtcatgtcgtcggtacaggtggcgggcggaaaagccggatcatacattcccttgtgctggtcgtgctggtggtggcctgtctgggtgtgcccttctacttgctggtggtgacggcgggtaaagaccaggcggaggcgctcaggctttccctggcgttgcccaccaagtggcatctgttcgagaattttggcactgtgctctcccagggcaaaatgatttcggccttctttggcagtttactggtgaccgtcccctcggtgttgttggcgctggtgttcggttcgatggcttcgtggatcctggcgcgccgtactacccggatgatggccgtggtgtacgcgctatgcatctccgggctgattttgccgccggcggtggtgactgtgatgttgctgctcaagatgattgggttggctggtacggccataggtatgatttgtgtttatgtaggtatctacttatcaactgtgattttcttcgtgacaggcttcatcagaacgataccggtgtcgttggaggagtcggcgcgcatcgacggtgcctcacccatgcgggtgttcttcactatcgtgctgcccctgttgggcccgacgatggcgtccgccaccatcctgctcatcctctacatttggaacgacgtgttttacgccttgttcatcctgtccgggaagatggataccttgccgctcaacctctataatgtggcgaatgcaggcttgtacctgaacaactggcactacatcttcgcatacatcattctaatgagcctgccgcttctgattatcttcgctgtggcgcagaagaagatcatctccggcattaccggtggcgcggtcaagtgagaccgggattggttgaccatcactcaccaccgtcggtttgaagcgatggttcaaagtgtggcaaaatcgaaacggtgctgaacggtagtcgtcgtacgggttcgcctggctgaggaatcgctccctggccgggcgaatccgtgtaggaagaggcagttcatggtcaatgcgcagcagcgaatgccgtccatcaaggacgtcgctcggcaggcgggagtatccgttacgacagtgtcgcgctatctcaacggtgggccgcacctgagcgagcagaagcgcttggccatagccaaggcggtggaagagcttaactaccggcccaacacaatagctcgggccctggtatctagcgaattccagtccatagccgtcatcgcgaccgacatcagtctgtatggcaccatgcaactggtgcagggcattgagcaggcggctcgccagcgcggttatctggtgacggtgacgctggtgggaaacggtaggggaaacgtacgcgagaccgttgaccagctgatacgcaacaggccaattggctgcgttatccttgacatcgaacggtccagcctgctgcactcctttgctggatatatagcgaaagcgctaccgacggtgattgtcgatgagacggaccggacccaaggcaatctgcctataggcgcataccatgggggttatcaggtgacccaatatctgcttaggcttgggcacaagactgtgtatcacgtggcgattcctgagaatggcaacacatatacgcgctcctttggctggcggaaagcgctggaagaagcgggggcggtggttcccagtccgataccttgctcctgggatccgcgcgaggccgagcagatagggcggtacctttcttcgtacttggaggtcaccgcgatttttgcgggaaacgacgagattgcggccggtgtcatacgtgggctactgctggagggtaagcgagtgcccgctgacgtaagtgtagcaggattcgatgataatccaatcggcgagctgacagtgccgagcatcaccacctggcggcaggattttcaggagattggcgcgagggcggttagcagactggccgatgagcccgacggcaagccgggcgacaagagtggagtgagcggcggcagagcctcgagcgaagggtgcacagttgatgatgaggtgccggctcggctaatcattcgtgagtccaccgcgccgccgccttcgctggcggcagcggaggggtgaattgctccgggcgggtatcgatgcgagccttgtcgccattgtctggggctgtgtggcgggcgagaaataccagtggctagagcgattctggggcaatcgggggatcagcgggtccagtcaaagccctgccgctcgatggagggcgccatggggtggtgggcgttctcctggccgaaggctttgtcagctatgatctgcctgaaagtcttacgcggtgcgtccatatggcggatgtcccggtagtagcggaacacggtctcgtcgaagtcagacagagcttcgccgatctcgtcttcgctgggtctacggtaagagttctcgaaaatctgcgctggccggggcatacgcggcttcagagccggaccctgagccggtttcccgatggcgaggcccagcaccgggtaaaccagtttcggcagttgcagaagctcaatcagctcgtctgggtcgttgaggaccgagcccaggatgacgcatcctaagccgagcgagtaggcggcggtctccatcgcgtggagggccaggaccgcatcattctccgactggaggaagacgtagctggagttcaggttgaaggagtccgcgtccatgtcggcgtcggggttttccgccgctaccaggtctgcgttgcgccgttggtcagccaggaaaatgtagaggaggggggcttggacgatgtaatcctgacccgcttcctgggctatggcttgggcaatcttcggatcggtgacacggatggctgaccactcgttgaaataacggctggtggcggcgtgctgggcggctgattccaaggactgcacgctcgcggggtcaatgggatccggggagaaggctcgaatggagcgacgctccagcagtacccggatggtttcattgggggccgcgcctcgcaggtcggtaggggcgcagctgtgcatagtacggtcttttggattggtcatactgccattctgacagtccgggggtatgagcgcaaggtttggagccgcgattacgttgctcgggaaaatcggtggtctcagatgccggtggtgatatcggacccgtcttaggctcagtgtttgttctgagtgcgctggtgacgccggtcgatcaaggcttgggaaccgcgatcggagagttcggagaccactgcggtaaaggccgccgagagggccgcgaaagccacgctggctagggcggtcccttgtccctgaccatcgccctcctggtctacgcccgaattgcgcgccttggaacgcgcatcccgcaccgaatcgaagagcttgccggccactaggccagtaacgctgggtagggcgagcttgaccagcttgtcgcctaaggaatcaggatcgttgttcacatgcgctcgcatctcgtccaccttctcgtccaatttgcgcaagcgctccaccgcacgatcggtggcagcgctagcatcatgcctatccgcttggctcatgcccctcattatcgcacaggacgccacggtccgcagggagcagcgcgcttgagcgaaaaggggtttgctggatgttagtctaggactatggtagacaaagctcagtatgccaacgatgaagctgaagcaagaggttgcctggtgctcttacgccatggagagacggagtggagccaatcaggacaatacacgggcagaaccgatctgcccctggtcggacagggaaggcgccaagctgtcgaggcgggtctacgcctggcccgtgagttcccggatgggttcgacgatggctgcgttttctcaagcccgctggaccgtgcccaacagactgcggctctggctggcttcgagcatgcgcgaaccctggagtcactcgcggaatgggattatggtcgcgctgaaggccgccgtgaggaggaggtctcgcgtctgctaggcaggccgtggaaactgtgggaggatggtcctgaagcaattgaccgccggctgggcggtgaccgtgaggcgcctttgccttcgggcggtgccgtccttgtgcggaatagcgatggtgagagcttgaggcaggtgagcgagagggccgcggctgtggtgcggcggttgcagcccttgatcgagcaggggcagcgggtcttgttggtggcccacgcgcatgtgctgcgcatactcacgactcagtggctgggcttggagccgtctgcggcccagctcttgcgcatgaacacggcccattatggcgtgctgggacggtatagggggggcaacgtccttaaacggtggaactgctgattggagcgttatgaagctcctctcgcctgattccggtctgatgcgtgggctatcggatttggctgatgccgtttggattaacgtcttgatgctcctgtcctgcattccagtcgtgactgtcggcgcggccctcacggctgcgcatgatgtttgcaggcgctcgctggaggggcgggggcatgtgacagctgactactgtaaggcatttcgcgctaacttcttgaaagctaccgggctttggctgttcttcggccccatgctggccttgttggtctgggcttggatttttctgcagatcacgcctttgctggtcgtcaaattcgggttgtctgtagtctgggttctcggcttcgagtgggtgtgggccttgcaggctcgtttcgagaattcgctggggcgcacgctatggaactccttcatcttttcggtctcccacataggctccagcttgactatgatcgccatggacgccctctatctggggctgatagcggcttcctgggtttacatgccgcaagggctcttcttactggtcatccttggtttcggtagcttaatcatgctccacaccccagttctagagcgtgccttcgctcggtacgttcggcaggaatcctggcgaggggcgaatcagtcgattccgggcgaacgttaggatagtcaaccatggtcacactgcaagatgtcgcgcgcgcggccggggtttcaatcgctacggcctcttgggccgtcaatgacaacaaggacgtacgtatccccgaaagcactcggattaaggttcgcaaagtagccgaggagctgggctacaggcagaatgcgcttgcgcggagcttggcccggggtcgctccgatctgattggttttatcagtgatggtgtggcaacatcacccttcgccggtcaggttatacaaggggcccaggatgaggcttggcgtaacggtaagatcctgctgatcgtggataccaatggtgacccactgattgagcagcgtgctttttccttcatgttggaacgccgggtggaggggatcgcgtattccagttgggtgcatcatgcggtaaagccacccgaggagctcaagcaggtcaactctgtgttgattaattgcttcgatgaaagcaggcggtttcctgcagtggtgcctgacgaggtgcaaggtgggcgcaccgccactgaactcctgctggctgcgggccacagacgcatagctttcattaatgagaaagagccctcgcccgcgtcggtcggtaggctcacgggatataagaaagcgttgtctacagcaggtattgagttcgatgccgggctgttgaccgagagcacggccgaccaggagggtggatatcgggctgctgggcgtgtgttggcatccggggccactgctgtcttttgccacaatgaccgtaccgctatgggcctgctggacgccttgcatgaacgtggggtgcgagtgccgcaggacctttccctggttggcttcgacaatcaagaggtcatttcggcgcacctgcatccagccctcacgactgttggcttaccgcagtatgaccttgggctgctgggtattcgcgctctactggcgcatgggcgacaggcgggtgctgtatctgctgtcggagaggttcttcgggtggcgtgcccggcgatcgtgcgtgaatccatccgggctctttaaatcagcgctttgcggcgaggagcgcctgggcaggtgcttttgcctcccagtttgacaacctaaagtaagcccttataatattgcttaatcgcttaaactactttggtagcggttttcggacttcgtagtcctggatgcattggtcgtagatgacctagccgctgcctgtgtcagagaggaacttatgagcaagctctactaccaatacctgggcacttggttcggtgactgcatgccatttggcagtggtgatgagttctttctcttccatcagcgtgacacccgtcggccaggaccttttggagaaccgttcggttggtcgctggctaccaccaaggatttcgttcattataaggattgcggcactgccatagagcggggcggcgatgaggatcaggatcagttcatctacgctggcagcgtctttgaagcggagggccgctaccacgccttctacaccggttataaccgtgattatcctgctcagggcaaagcctcgcaggtgttgatgcacgcggtcagtgatgatttgtatagctggacgaagaccaaggatgctctgacctttactccgcaagagggctacgatcaggacgattggcgcgatccctgggtgattcgcgacgatgctcgcgggctctatctgctgatactgggcgcccgacttcaaggacccaagacgcagcagaccggacgaaccgtcaaattcagctcgcctgacttggagcactggacctttgaaggggacttttgggctcctgacctgtacaccatgcatgagatgccagatctgttcaagatgggtgactggtggtatcacatcgtgaccgaatatagcgataagcacggcatggtctatcggatggctcggagcttggatggaccttggacggcgccgacggatgatgcctttgacggcagcgcttattatgccggtcgtacgtttgagcttggtgggaagcgcgtactgttcggctgggtcggtaccaaagagaagaacgacgatcggcgaaactatgaatgggctggcaccttcgtgccccaccaggtgtaccagcgtcctgacgggagtctgggggtcaagcctgttgatacgctctgggagtcgtttgcgcaatttcgccccattgatgatttgcgcctgaagtcgacggatggccgtcggaagcgggtgctggcgagcgactgtggcgatctcttctctttcgatgctcacgtcaagtttgaggagggaacccgatccttcgggttccggatatacggggatgagggaactgggcaatcctaccagtacatattcaaagtcagggagaaccgctacctctttgagggcagtcctaattacccctggtttacgaacatgaacatcggcctggagcgtccaatcgagctggcgcccgatcgtgattatcacatccagttgattgtggatgacagcattgccaccctgtatgtcaatggcgtggctctgaatgcgcgcgcctataagcactatggcgacgacctgagcgtcttcgtcaccgatggggcagtcgagctgtccggtatgtccatcagtcgatcgttgaaggaggaatagaaaggctaccacttcatgattgtgatgtcggaggtgcctgccgatgttgccaatggcaccgccgggcatcctggccgttgtggtctacggccgtattgcttaagcggttatccataggcgggtatcgctagagcggaccatttcccgccgtaggcgggctcagacagatatatattgggagcgtcttatgaacacaatagtgagagtgacggcagcagtcggggctctggccatgtccttgacagggttgagcgcctgtggctcatcgtcggccagttcggacaaagggcacgtgtactacctgtccgctaaacccgaacagcaagatgaattcaaggatttggccaagcagttcaccaaggatacaggcattccagtcgatgtctccgtcgcgtcatcgggcacctatgagcaatcgctcaagagtgagctggcaaagtccaacgcgccgaccatgttcgacgtcgacaataacgatttccagaactggggcagttactacgcggatatgtctggcacgcagatatacaaagacctgaaaaagtccgagtgggcgcttaagttgcaggacaaagtggtggccgtgccatttgtaatggaacgctatggcattatttacaacaaggcgctgatgaagaagtacttcgacgctaagtggtccacggtcaagtcgatcaaagaggtcaacaacttcaaggcgctgaagactgtggccgatgagattcagaagcacaaagacgatattggggttaagggcgctttcagctctgctgggtttgactcaagctccagtaagagattcggcgatcagctggcccacatccccgtgtattacgagtatcgcgatcaacacgtgaccgccgagccgccaaccctgaccggcaagtatacggacaatttcaagcagatcttcgacctgtacatcactgacgctactgttgagcccacgcagctgtcgagcgccacaatggacgactcgaacaacgaattcgccagcaagcagtcggtcttcctccagaacggttcctggggttatccgcaaatcaaaggtcaggaagtgccggacgaagacataggcgtgctgcctatctacatcggtgtccccggcgaggagaagcaggggcttactgtaagcttcatgtatttcgcaaataataagaacgcttccgccaaggacaaagaagcaacggccaagttccaggaatacatcctgaacaataagaacgggcagaagatattcacggacgatatgggcttcgagacgccgtttaagtcgtatgacaaggctggattcaaatccacgaacccagtgcagcgcgctaatgacgcttacgcaaaggccggcgactatgacacggtgatatacccgctacccagcgcccagtgggtggcctcgctcagcgatgcgatgctggagtatgcccaggggaccggtaagtggtccaaggtgcaaactgcgttcgtggacggttgggccaaagagtacaagaccacccactgatggcggccccgggacgtcgctgacgccccatgcgcgcgggcggtgaagctattccgcccgcgcctctcgtgagaactgatctgtgggcttgggaggttcctatgatctctatgattggtaagtcgatacgtcggtggtggatgctcttctccctaccgactctggcggctttcattattggctttttagtacctttcgtgatgggcatatacttgagtttctgtcatttcactacggtgacggacgcccggttcattggtgcgggcagctatgtagaagctttgcaagatccggaattctggcatgcgatggtgttttcgattgcctttacgctcatcactaccctggtcatcaacgtctgtggtttcgctgtggcgtatatgctgacgaaggcaattaagggtgccaatgtattccgctccgtgttcttcatgcccaacctgattggcggcatcgtcctgggctatgtgtggctgctcctgctcaacggtgttctggttcattgggaccggtccatcacgtactccggcgtctatggattctggggcatggtcttgctctactgctggcagcaaattggttacatgatgatcatttacatagcaggcctgcaggccttgccgggtgatgtgatcgaagccgcttccgtcgacggcgccaatggtcgtcaaactttgttccatgtgactattcccttgatgatgccttcgataacggtttgcgcgttcttaaccatgaccaatggattcaagatgttcgaccagaacctggcgctgaccaacggcgccccatccaacgcctcggagatgctggcgctgaatatctaccgtaccttctacgggcgtgcgggattcgaaggggtggggcaggctaaggccgtgattttcttcgtcatcgtggctttgattgctttgattcagaacagattgaccacatccaaggaggtggtggcatgagcgccaaagtaaagcatgaaggctggtggagcctgctcttcgctgttgtcagcttggtatggattttccccatcgcgctggtcgtaatcaactctttcaaaaacaaggcttatatcacccgtaacgcgttctccttgccgaccggccatgcgttcgtcgggttcgagaactactcgcgcggtatcgaaaagaccaatctgatcgcttccttcggctggacggtgatgattaccgtaggttcggtggctctgattttggtatgcacgtccatgtgcgcctggtggattgtgcgcgttaataactgggtggctaaagcgctctatctgcttttcctttttaatatgatcgtgcccttccagatggtcatgttcaccctgtccaagatggctgacatcgtcgggctgaacacgccctggggattgtgcattgtgtatcttggttttggagccgggctcgctgtcttcatcttcaccggtgtggtcaaaggcattccccaggagttggaggagtcggccatgatggacggagcaagcgtgccgcgcaccttcttccaaatcgtggtgccgatcatgcgcccctcggtcgtttccgtggcaattctggaagccatgtggatttggaacgacttcttgctgccgtacttgactttggacatgcgccgtttcaaaaccatgagcatcgcgattcagtacctcaagggaggttatggctcagttgacatgggtgcgatgatgggttgcctggttttggcgattatcccgattgtcgttttctacctggtctgccagaagtacatcatcaagggggtgttggctggagcggtcaaggggtgaaggtcgtctgccctgtagcgttctcgggataggcttaagtctacggttatatcgcgatgcaggggagcagcgtcgggagaggggtttgcgtggtggcagacagaatagacggggactggtggaagcaggcggttgtgtaccaggtgtatcctcggtccttcaaggatgctgacggggatggcttgggtgacctgcggggcatcatcagcgagataggctacctgaagcagctgggtgtagacgccgtatggctctcgcccttctacccgtcggagttggcggacggcggttacgacgtgatcgactaccgcgatgtggacccgcgcctgggctccatgaacgactttgaccagctggtcgacgggttgcataaggctggaatcaggctgatcgttgatctcgtgcccaatcacacctcggaccaccatgcctggttcaaggaggcgttgaaggcgggcaggggctccgatgcgcgcagccgctacatcttccgtgaggggcgcgggaagcatggggagctcccgcccaacgattgggcttccatgttcggtgggtccgcttgggagcgtgtgccagacgggcaatggtacctgcacctgttcgccaagcagcaaccggatttggactggaagaatccggaggtgcatgaggatttcagacgcaccctgcgtttctggtcggatcatggggccgatggtttccgcatcgatgtggcccatgggctggcgaaagacctggacagcgtccccctggatcagatggatcctgccgccgtccagcaagggtccttgagcgatggttcgagtcctctttgggaccgggatgaggttcatcagatttacaaggagtggcggcaggtcttcaatgagtacgaccctcctcggttcgcagtgggcgaagcctgggtagccccggagcgccagtaccgctatgcgtcgcccgacgagcttgggcaggtcttcaacttcgaattcgctaaggcggactgggacctttcgcagatgcgtcgggccatcgaagaggggatggcgaacgcgcgccgttcagggtccacgactacctgggtgatgagcaaccacgatgtgcctcgccatgccagtcggtacgctctgccgcaggtcggctcgaccaactatcaccagttggccaaggattggctcttgcgcgatggccgttcctaccccgaggaccgggccttgggcaccagacggtcccgtgcggccatcctgctggagctcggcttacctggttccgcatacatctatcagggcgaggagctgggactcttcgaagtggcggatctgccttgggaacgtctggaagacccgacagcgttcaatacctcgcaagccgctagcgacaaaggtcgtgacggttgccgggtgcccctgccctgggactgcggggatcggcctgacccggatgcctcggcaccggctttcgggcgcggggcctcgttcggcttctcgcccgcagcgcgggaggacggctccgcgtgtgcggaccctcatttgccgcaaccgctttggttcggtgattttgcggtcaaccgcgaggaagcggaccctggttccatgctcaacctttaccggcgggcgttggctgcgcgcgcctccatgctgacgggtttgagccaggaaattgcattgtcccagccgcaggagcggactctggcgtactcccgagccgatgcggcagggaaacccgccttcgtgaacctgacgaatttcggtcccaatcccgtcgcgttgcctgatggcgaagtcatcctgagctcggtgccgctggccgacggcttgttgccttcggacgcttcggcctggttgagtctgagctagcccgccgcccggtttgcccggttccgatcagggatgctcgggtgcggcacgccgtcttcgcgggcgcggagccgttcctagccatgcgctgggggcggctctttttgttttcggatgttttggcgaagcgggaataatgagttgcctacggaagttgagtgatgtaggctcaagtttcagtggcgggttgccgggctcctggagacgggagcgggcgggccgctgatggatgagagcgataacgtaacgcaaggaaacgaggctccgggcgcatggcccgggccgcaaaagccaggaggcaacacaatgggacgtgcagtaggcattgatttgggcactacgaactcgtgcatcgctacgctggaaggcggtgagcccaccgtcatcgtgaacgcggagggcgctcgcaccacgccttcggtcgtggcgttcagcaagtccggcgagatcctggtcggcgaggtggccaagcgccaggccgtcactaacgtggaccgcaccatctcctcggtcaagcgtcacatgggcactgactggtcggtggagatcgatggcaagaagtggaccccgcaggagatttcggcgcaggtcctgatgaagctcaagagggacgccgagtcctacctgggcgagccggtgaccgacgcggtcatcacctgccccgcatacttcaatgacgcgcagcgtcaggcgaccaaggacgccggcaagatcgccgggctcaacgtcttgcgcatcatcaacgaacccactgcggctgctctggcctacggcttggagaagggcaaggaagacgagcggattctggtcttcgatttgggcggcggcaccttcgatgtgtccctgctggagatcggcaaggatgaagacgggttctccaccatccaggtgcaggccaccaatggcgataacaggctgggcggcgacgactgggatcagaagatcatcgattggctggtcggcgaagtcaagaacaaatacggggtggacctgtcgaaggacaagatcgctcttcagcgcctgaaggaagctgccgagcaggctaagaaggagctctcctcctccagctcgaccaccatctccatgcagtacctggcgatgacccctgatggcactcctgtccacctggacgagcagctgacccgggctcacttcgaggagatgacctccgacctgctgggccgttgccgcacgccgttcaacaacgtgctgcacgatgccgggatctcggtcagggacatcgaccacgtggtgctggtcggcgggtcgacccgtatgccggccgtgaaggacctggtcaaggagctcactggcggtaaggaagccaaccagaccgtgaacccggatgaggtcgtggctgtcggcgctgccgtgcagtccggtgtcatcaagggcgaccgcaaggatgtcctgctgatcgacgtgaccccgctttccttgggtattgagaccaagggcggcatcatgaccaagctgatcgaccgcaataccgcgattccgaccaagcgctccgaggtcttctccaccgccgaggacaaccagccctccgtgctgattcaggtctaccaaggtgagcgtgaattcgcccgcgacaacaagcctctgggcaccttcgagctgaccggcatcgctcccgctcctcgtggcgtcccccagatcgaagtcaccttcgacatcgacgccaacggcatcgtgcacgtgtccgccaaggacaagggcaccggcaaggagcagtcgatgaccatcaccggcggctcggccctgcctaaggaagagatcgacaagatggtcaaggaggcgcaggcccacgaggctgaggacaagcagaagcgcgaggaagcggacacccgcaacaacgccgaagccgctgcctaccagaccgagaagctggtctccgacaacaaggacaagctctccgaggacgtggccaaggaagtcaccgagaaggtggacgctctgaaggaagctctgaaaggcgatgacatcgagaagatcaagtccgcgcagtccgagctgatggactccgcccagaagatcggccaggcgctgtacagccagcagggtgaggcggctggcgcggctggcgccgccgatgcgggcgccggtcaggctggtccctcctccgacgatgacgtggtcgacgccgaagtggttgacgacgacgagaagaaagatggcgagtgacatgccgacgttcgacaaggacgattacctgaacggcatgccggacgccgagtcgctcaagggcgacccggcgtccgccggaagtgaccagcatggcagcgattccaaggccgataagggcggggctgacgacaccgcccagcaagacacagccaaggaaaccgatgcggttgcaagcgacggccaggaccagcagccaggctccgactccaagcaggaggacgacttgacccctctgggcagagccaagaaggaggcggccgactatctggacgccctgcagagggagcgggccgagttcgtcaactaccgcaaccgcacgctcaaggagcaggacaccttccgccagcacggcatcattgacgtgctcacggccctgctgcccgccctggacgacatcgaccgcatccgcgagcacggggagatggacgactcgttcaaggccgtggcggccaagatcgacaagaccttcgagaagttcggtgtggagaagttcggcgagaaaggcgcggacttcgaccccaccaagcacgaggcgatcctgcgcaagccggaccctgaagccaagaaggagaccgtggacacggtcgtggaggccggttaccggattggtgaccgcgtaatccgcgcggcgcgtgtggtggtggccgctccccagaagcaataggtcggtggtggcgtctgataaggaataaggaaatttctagtgaagaaaggagacatggatggctgagaacgaatggctgaacaaggacttctataaagtcctcggtgtctccaaggacgccagcgatgcgcagatcaccaaggcctaccgcaagcttgcgcgcaagtaccatcctgacctgaacaagaccaaggaggccgaggagaagttcaaggatgtatccgaggcctacgacgtgctgagcaacaaggacgagcgcaagaagtacgacgccatccgccagttcggcatgggcggcgcgcggttcgccggagggacctcgggttccggtggattctcgaccgacgacatcttcggcgccatgttcggcggcggcgccggtggtcaaggtgggtccaggatccgcttctccagccccggcgctggcggacccgacctgtccgacctcttctccgccttcggcgggggagcggcgggcggcggtccggcgggattcgggcggcaggcctaccaggaggagccgcccagggcggccaagggggctgaccgcaactcgaggatctccctgaccttccgtcaggcggtcaagggtgccacggtctccctgagcgtgggtgggtcgaagttcaagacccatatccccgctggggtgcatgacgggcagaggattcgtctgcccggcaaaggcaagcccggcatcaacggcgggcctgctggtgacctctacctggagttgagcgtcaagtccggcggccggttctcgatgaacggcaaggacgtggtgatggatttgccggtcaccctgtccgaggcggcgctgggggctaaagtgcgggcgctcggcgtggacgatgagctggtgaccttcaaggtccccgcagggtcgtccagcggcagtgaagtcaggattgcgggcctgggagtgcaggaccggcgcggcaaaggtgatttggtgggccgggtgagcatccagctgcctgccaaactgggcctgggctccaagcgcgctgtgaaggaattcgccaagaccaccgaggaattcgaccagcgggtggctgacgaccgtatgaggatttgagctggcgaaacgcatacagggccactgaccttgtatgtgagtactgatgaagttgcgaaggcggggggcgctggggctgatggctccggcgcttcccgtccactcgatggggtggcctggcgcggcccggtcgggtcggagacggactgacgcctggagggggaagcgatgacggcgatggataagcagattcgcgagacctacctggcctgcggccgggcactggtggaaggctcagccgggctggacctgatcgacgagcggggcatagacatcagcctgcctgtgttcagtgtggggcaggtggcgcagatggccgacgtccacccgcagaccctgcgccaatacgaccgcctggggttggtggtacccaggcggaccgggggcggggcccggcgctattccttgcgtgatgtggaccggctctgccaggcccagcacctgagccaggacgaatccatcaacctggctggcgtgacgcgaatcctggccctggctgaggagaaccggcagctgcgccggcagattcgccgcctgaatcagcccgatggcagcaatgttttctccgccgacagcgacggcgaggtggtggagatggaacgctccggccgggcgcggctctggcggcatcaggcgcaggtcaaggtccgggggctgttgccgcccgccgacgaaggctaccgggatgagggtgattacggggatgacgactaccgggaggacggcgaccggcctttaggcgagtcgaaatccctggtcatttggggcctgctttgacccggcatggaaggcgttgagcgctgcatcggttttgctcgctgagcaggctgccgcgcggccgtccttgtagggctggccaatcattggaattccagggaatgctcaagcacgccgcgctcaggcagggaggggatgatgccctcgtggcctagggagaggccggcggctttgttggctatgcggatggcctggtcgagcggacggccgtagagcaagtatgcggccaaggcgctgatgaaggcgtcgctggcaccggtgtcggccgcggctttaaccggagtggttgggaaatcctgttcgccgtcggccgtgtagagggtgcagccatcttggccggtggtgaccaggaccatgcccgccccgtggttgatgagggcatgggccttgtcggcgcggctgccgggaccggggcataggcgctccaactcggcggaaccgggcaccagtaagtcgcactcgtgcagcaggctggaaggcagttcggcggtatggaagggtttgatgatggtcttggcgccgtggcggtgggcgaggcggcaggcctcttcaagagcggggaaggggaccacggtttgcgccaagcaatacgaggcccgctcgaacaggtgctcagcggcgcgcacgtcttccacgctcatcagcgcattggcaccggccgagcgcgaactcatggtacggccccggttgtcgacgaaaatatagactttgccggtatcgctaccgggtttgcgccggatgccatcggtgtcgacaccgctctcggccaggtagcggtaaatctggtcggcttggctgtccgagcctacattggcgatgagggagacgggctgacccagcttggcaacgccgaccgcctggttggcccccttgccgccggggaccgagaaggggtcgtgggagtccaccacgtttccggccttgggcagggtcggcacgcccagataggtgtcggtgttgatgctgcccaccaccacgatcgagcgctgggtcagctcggccggcccggccagtgtgcgctcgctgcttaagtggaaggtctgtgtgaaacctggcgcttccttgcggccgccttcgatggcgttgaccatgcgggtgcataggtaagcgccgaaatccgcgttgcgcatggtgtaggaggatatctcgctggagcccgggtagtgcagcacttcgctggtgtcgttgcgcacggtgaggatggagaagtcctcgggcactcggtagtgcaggctggaggcgtattggaagagttccagggcgtgcttgtagtgggaggagaccacgccggtgacctgtcgggagctgatgcgctccatcagggaatcgcttggctcgtggatgaccatgtcctcgctgaactccatgttgtgctcgaacaggcagcgtttgaagccgtttaggaagctttcggcgcgccggcccggggtcagcaggcagaccaggtgcttatggccgcgttcgatgagctcctgggtcaggctgtatgacgcctgctcgtaggggagcatggtgaattcgtcgtcgcccagggggccgatggtcagctcgggaatatggatttccgggcggcccttgcctgggagcaagctgcccgagtcgacaggctcccaaatcaggccgtcgacgcgctgtgacagtgcggcggcgatgttggcgcgttcgcgctctcggtcctggaagctgttgaagaccagggtgccgtagccgtggctctgggcggtctggacgatgccgtcgatggtggtgtcggtggcgacggaatcgcgcagcaggacgccgattcgccagctgcggccgggctgggctgagactgaggcgtaggggcggtagtggtattgcttgactaattggagcacgcgctcgcgggtggcctcggcgatgctgtcgtctttatggttgacgatttttgacacggttgacgtggagacgccggcaagttgcgcgatttctttgatgttcatgggatgctgattccttttggtctgcgccagtcccctttcctccatagtagcgtggctccctaatgtgacgagggtcccggagggccgcaagcccgtgatgggcgcgattcggctcctgaccgagcggccgttattctctgggtggcgctgtggttgacagcttgtgggggctctgctatcttgtcgggggaaaaacgtttcggaaagtattttactcccatgcgtctgttgtggggacggtcggacttcttcgtggaaaagcaggaatagaccaatgaattcacgcccaatcatcatcgacaccgactcgggggtcgacgctgccgcggccatcgctctcctgaacgcggagcccactatcgacgtgcggctggtggccagcgtggcgggccgcaccgcggcggaccaggcggcggtcagagccctgaggctgatgacattcctgggtggggccaccctggttgcgcagggctccaaggggccgctcgccagctcgtccggtttgccggaagtagggccctgccacagcgacctggatgcggcgggtctgcccgagccggacatggggcgcatgagccggaccggggcgattctgaaggagcggcggattctgctggccagtgaacggccggtcacgatggtgacgctgggtccgctgaccaacctggcgctgctgctgacctccttccctgaagtgcgcgagcgcatcgagcgcatcgtgatgatggcgggctccaccgaacggggagacgtgagcccgtatggcgagttcaacgcggtctgtgatccgcatgcggccgacgtggtgctgcgctcggggctgccgctggacatggtcggtctgaacgtggggcgcaagctgctgctgaacgaggcggatatgcccgcgctggcggcgaccgggcggaccggctccatgctggtgaggctgctgaggaccatgagcgcccgttgccaggccacgttgctggcagcggcgcctgcggccgctatgtacctgctggaacccgggctgttcacgacccgtggggccagggtcgacgtggaggtatccagcccgctgacccggggcgctacggtcgtggacttcgaggctgagcccaacgccacggtgtgtgtggacgcggacagctgcggattccgggcgagcttcctgcggcgtatggccgcgctcgacggcgcgcggaggtagcgcggaaatgccaggttgccaaatctgataaaacgttttattgttattcatggatgcaatgcggccctaagcctgtctagagttgaagaagactccacggagacttcttttgctccgggcgccatggacactgttgaaaggtgacgacaatgaagaaaatgattctcgatcttgatacgggcatcgacgacaccctggccatttcgtacgccctgggcagccctgaggtggagctgattggcattacaagcacgtacggcaatgtgctgcttgagcagggcatgcgcaacgatctggcgatcaccgacctgctgggtcacccggaggtcaaggtctatccgggcctgccccactcctccacgaccgactccttctcggtgctgccgatttccgagttcatacatggcaagaacggcatcggcgatgtgcagatccccgattccacgcgcaagcccgagacccagtccgctgtcgacttcatcatcgacgcggccaagacctatggccaggacctgatctatgtgcccaccggccctatgaccaatatcgccgcggccctccgcaaggcgcccgagatcaaggaccagatcggcaaaatcgtgctgatgggcggcgccctgactgtatgcggcaacgtgtccgcctggtccgaggccaacatctcccaggaccccgacgcggctaacgagctcttccgctccggcgccccggtgaccatgatcggcctggatgtgacccttcagacgctcctgacctataaggagaccgcgcgctggcgcgacctgggcaccaaggcctccgccttcctggccgacatgaccgacttctacatcaaggcttacgagaccacgtctccccacctgggcggatgcggtctgcatgacccgctggctgtggccgtggcggtcgatcccaccctggtgaagaccctgccgatcaacatgcaggtcgatgtggaaggccccacccgtggccgcacgattggcgacaacacgaggctgaacgacccgcacaagaccatgcaagtggctgtcgaggtggacgttccccgcttcctgaacgaattcatgagccgcatcggtgggctggcccagcaggcaggctgaccacactttggccggtccgtccacaataaggcccggcgggcggcgcaatccgacacgccgcatacaatttgaaattggcaacgtagtttgcacacaagaaaaggaacactatgactgagtcgtcaactcgagcggccgtcgatccattcgacgacccggagaccagcaacaagatggccgtccgggccctcgttttcctccttatcaccttcatcctgggcaccttgtgcctgcaaggattcaacctggtcttccagcaggtcggtaaggatgtgggcgcggtccagcaggcctcgctgatcacggccctgccgagcatcgtgctgggaattgtctgcttcatctacgggtcgctcggcgacttcgtctccctcaaaaagctggtggtgaccggcctggtcgtcctcttcatcggctccatcttcggtttcgtggcgaacttcttcttcaccgccaacctgtggacggtcatcatcgcccgcatcctgcagaccgcgggtgagcaggtggctggctcggtctacctggtcgtcacgaccaagtacctcaagccttcgctcaaggtggtggccttcggtgtcttcaccgccggctaccaggtctccgcggccatcggcgtgttcgctgccggcttgctcagctccatctcctggcagtacctgttcctgattccggcgatcaccatcttcttccttcccgccctgctcaagtccctgccgaacaagagcggctccggcgataaggtcgattggttgggcttcaccatcttcggtctggccaccgcattcctgaccttgttcttctcctacaccaaggtttggctgcttatcgtggccgctgcgctgtacgtcgtgttcggcgtatacatcaccaaggccaaggacccgttcgtgacccccgagttcttcaagaacacccgctggatcatggctatctgcctgattctgttcttctacttcaacaactactgcatgtcgcccatcttcaacgcgatctgccgtgacgtgttcggcatcaccaactcggccaccgtctccatgcacatcgtctgggccttcctggtggcggcgttcttcggcaccacgtccggcgcgatcgtggacaagatcggccgtcagcccacgctgatcatcgccgcctgcctgatgatcgtgggctgggccggttccgccttcgtcatctcgtccggcctcatcccgctgaccctgatggcatgcgtgttctacgcgggtgcaggcctcatgtactccccggtggtctccaccgtgcttgacaccctgcctaaggagcagtcgggccgtggcgtgggcatgaacgatctggtcatgaacgtgaccggttcaatcggcatcgccatcttcggtggcctgatggccggcaccggcctgggtggcggctccatcgctggaggcgccggccagcaggcggtctacgccaacttgctgctgatcgcggcggtcatcgcggccctgggcctggtcatctacctggtcttccgcaagaagatctacgccgaggactgatagccctcctgtagtaccccgccagcgcgcgtccggttcctccgggcgcgcgctggccttataagccctgcgattcgcgctccgcccgccttgactttcgctgttcgccgctgcttgcggattgcggatagcgaatcgcggcgggggtgctcacgagggccagggaaatgcatggatggcggagccggcggtatccgatgcgcaaggattgggggccatcagcgtggggaatatgtgcaatatctctatggtttccaggggtgaaatggggattgggcttctaaaatcgcatgtagcgggtgtattgaacgagagaacagtggagactgcatggagcgcgagggcgagatggtgctgggactgccgcatgagggctacggacgtacttgggccaaggccatcctgatcggtgagcactccgtggtctacgggcatccggcgctggcgctgccgcttcacagcctgcggatgcaagcatgggccgccccagccaccgagggcgaggagccccagctgagcgcgttggactatgaggggccgctcgctggctcgggggagcgcttcggtgggttgcgccgggctgtggaagtgacgctgaactacttagggacgaccgggcagggtttccatatccgcaccgaatccgactttcccgctgggcggggactggggtcgtcggccgccgcgtccggggctgtggtgcgcgccctgttggacgcatacgacgctgcggtgagcgatgaggacatactgcggctgaccaaccaggccgagcaggtgacacacgggcacccgtccgggctggacgccgccactacctccggtcaggggcctgtacggctggagcaaggcgctatgcggaccgtccgcccccggggcgcggcctacctggtgattgccgacaccggcgtggccggctcgaccaaggaggccgtggagggcgtacgcgggcggctggaggctgacccggacggcgtgggccggctgatggacgagctaggcaaccaggcggccgccgcgattgccgacctggaagccggacggatggagccgctgggcgaccacatgaaccaggcccaagagctgctggatgccctgcaagtggggcatcccacactcgacaagctggtccaggaggcgcgctccaacggtgcgctgggcgccaaactgaccggaggcgggctgggcggctgcatgttggccctggctgcggacggggatgacgccgaccggattgggcaggcgctcaaggcgcagggcgcgcagcaggtgtgggtgcaccggctcgtggcgtgatagccatctggtaacggcccgtgacggccgaaaacgattgggatcgggaactggactacgctgtggtgcggcaccggtcgaaggtaaagcgaaaacggctggtataccagcttcgcgacgttggagatacgccgcagactggagcccgcttggatgcgctccctgcggatagtggggatactgtcagatttccggcgcaaacgtgcggacgggcggcggaactggctaccctattggatatgaacctgagaagagtagggggccggccgctccctggcgccgcagcgacggccacgctggcgcagggcgagcgggcggacggagcgccgttaggccgcggccaggcgcgggccaacgccaatatcgctttgattaaatactggggcaaggccgacgaggacctcatcatcccgcgtacttccagcctgtcgctcactctggacggattgagcacgaggaccgatgtggagtttctgcggtccggcgctgcggacgggccagcggcggactccctcaccattgatgacgaaccgaagtccggcaaacccctggaacgagtcagccggttcctggatgtagtgcgcgcccaagcaggaatcgatgccccggcgcgcgtgtgttcctataacaccgtgccttatggggcggggctggcctcctcgtcgtccgcctttgcggctctggctggggcggcttgtgcggcggccgggttggaattgtcgaaccgggagctgtcgcgcttggcccggcgcggctcggggtcggcctgtcgctcgatttacggagggctggtcaagtgggaggccgggcatgatgatgccagctcctatgccgtgcctgtggaatcggacctggatctggcgttgatagtggtgttggtctccgggcaggaaaaaacggtttccagtcggctggccatgcgccgcaccgttgagacatcacccttataccaggcttgggcggagcaatcggccgtcgacctggatgaggcgctggcggccatccgggcgcgcgacctggagcgcctgggcgagctggtggaggccaacgcgctcggtatgcacgcggcaatgctggcggcccgacctgccatctgctactggcggccggagaccctgcgggtttttgaagccgtgcgtgccgtccgagctgacgggttgggagcctggtccactctggacgccgggcctaatttgaaggtgctgaccgggggagggcaggcggcggcggtggccgatcagctgcgtgccaggctgccgggtgtgaacatccaagtgcaccgggctggcccgggcttgcggattatgggtatgaatacagacgagggtcgctgctagcgaagaggaaagggccagctggggctggcatgatgatggataaactccattaaaaacgggctcggcctgcaaaggaagcgtggtgacgatgagcggaactgtcgacaagcgagcggacgccgccggcaagctttacttggctggtgaatacgctgtggtggaacccgggcatccggccatcctgctggcggtggaccgcaccctgaccgcacgggtgacgggaccggcggcgtccgatccgggccaggaagcggacggtcagaccgggcgcatcgagtccgccggccaccctgaggccagcaccaactggcatcgggagcgcggcatcctgacgccggacgtccggccggaccagccttcctacctgctggccgcggcgcgcaccgtggaggagttgctggcccagcgcggcatagccccgcgccccttcgatctggagatcagcagtcggctggacgacagttcaggcaagaaatacggcctgggttcctccgccgctgtggcggtggcaacagtgcgcgtcctgttggacttttatgggctgcgactgagcccgcttgaaacctacaaactggcctatctagccaccgggcgcgctcagagcctgggttcaggcggagacctggcggcctccctgttcggtggctgcatccgtttctgttcgcctgaccgggcctgggtgcgccaacggttggtcagcagcccaatctcccaattgattgaggagccttggcctcggctgagcatctcccgcctgcgggcgttcggccccgactcgcccctgcgtatcctggtgggatggaccggcagccccgcctccacgccctcgctggtcgcctccgtgcagcagggctcggcggatggtaagcgggctgattatgagcgtttcctagctggttccgacgcctgtgtggacgccctggcgcgggccttggaccgcgccgatatggccggtgtgcgggagggcttggcccaggcccggagcctgttgcaggggctgtccgccctgaccgacactgacatcgagaccccggccctgcgcacgctggtggaggccgcgctgttgcggggagcggcggcaaaatcgtccggtgccggcggaggggattgtggcatcgccgtcatagatgggcgcgggcctaggccttctgcttccgccgggtcctctcgcgccgggtggctcggcctgtccgcggccattagcgcggcctggagccgggttggcatcgagcctttggggctttcggtaagccagcctttggcgcctctggctgattgggaatcggcagcggctccaggggagcgcgcatgagcgggtcggcaagcgccagtgggcagaccggggtttccgacggttttgacccgtctgcggacgctaatccggattcccggcgcaaaaacgaccacatccgcctggccctcgcccagcagcaggtccccaagcgcaacgcttttgacgacctgcgctttgtccaccactccctgcgggccgtggaccaatcacaagtcagcctggctacccgcgtctgcggctccgactggccactgcccttctatatcaacgcgatgaccggcggttcggccgaggctggccggatcaacgcccagctagcccaggccgccgctgccaccgggctggccatggccaccggctcccagcacgcggccctgcgccgccccgagctggagcccaccttcaccaccgtgcgtaagcagaaccctagcggcttcgtgttcgcgaacgtgggccccaccgtcagccccggacaggccgtccgagcggtcgagatgctcgccgcctccgccctccaggtccacatcaacccggtccaagaggccgtgatgaccgagggcgatcgcgatttcggttcctggcccgcccgcatccaggccatcgtggctgccagcccggtgccggtggtggttaaagaggttggattcggtctcagccgccccactatcgagcgcctggcctcgctgggcgtgcgcaccgtggacgtctccggccgcggcggcactgatttcgccgtgatcgagaacgagcgccgtgccgaccgcgcctactggtacatggattcctggggcctgtccaccgtgctgtccctgctgaccgcggggtggcccgagccggtcgccggcgtagagctcctggcctcgggcggggtccgcagcccgctcgacgtggtcaaggccctggccctgggcgcccgcgcggtcggtgtctccggccacttcctggccacgctgaacgagcgcggcaccaacggattgattgacgaaattcgtgaatggtcggtccaggttcgtgccctcatgtccctcctaggtgcccgcactgtcgccgacctgaccgccagcgacctcctgctcaccggccccaccgccgaggaggcccgcctgctaggcgtccccctggagtccctggcccgccggtccgctcgtgcgtagctccgctgccactttgcggtaagagggcttcttccgccagctggataggcgccctgtgctagagtgaagttcgttggctctcctgcctctgttgaggtgggctgaatcgggccaatcgtcgcctgaatgctttgattgccgggaatcttccgcgaaattctttgctttgctcgcggccaggcgggctgccgaccggtagcgccgctcaatgggttccttggtggaaggcaaaatttgctcacactcgctatgcccgccctgggcgaagcgtgctgtgacgcctgcctgtcagcagcgaacctcacaatgcacatgcagatatggaacagatgagtacactagctgtgaacgaaatgacagccgccgaccagaccgaggtcgccgacagcaccgaggcccacgagatggccgcaagcagtatgaacgccgaaaccgttgacccctccgccggagcggccgatgaagctcccaagactttcgcggagctgggtgtgcccgagcctctggtgcgagtgctcaaggccgacggcaagaccaccgctttccccatccaggaggacaccctgcctgactcgctcgccgggcgggacatcctgggtcgcggccgcacgggctcagggaagaccctggcttttgtgctgcctctggtggcccgtctcgccgccagccaacccgaccgtcgtcgggtgcgcgacatccgctccaagccggctccccgtggcctgatcctgtctcccacccgtgagctggccaaccagaccgatgaggtgctggcgcccctggcccgcgtctacgggctcgacacctgcaccgtttacggcggcgtgcgccagaacaagcaggttaacgccttgcgctccggcgccgaaatcgtcgtcgcctgccccggccgcttggaggatctgctccgccaaggcatgctgaccctggatgacgtggagatcaccatcctggacgaggccgacgagatgagcgacatgggcttcctgcctgctgtggagcgaatcctggaccaggtgcgcgacgacgggcagcgcatgctcttctccgccacgctggaccacggcgtggataaggtggtcaagcgctacctgcacaacgccaaggtgcacgaggttgattccgccacccagcaggtggagcagatgacccagcacgtgttcgagaccacccagggcgacaagcacgagctggtgcgcaaactggcctccggcaagggcaagcgcatactcttcacccgtaccaagttccaagccaagaaactggccgcaaacctgaccaaggccgggatcccggcggccgagctgcatggcaacctgtcgcagaaccagcgcgaccgcaacctggacgccttctccgacgggcaggtgcgtgtgctggtggcgacggacgtggccgcgcgcggcgtggacgtgtccgacgtgaagctggtggtgcaggtcgacccgccggcggaccccaagtccttcctccaccgttccgggcgtacggcccgcgcaggcaaggctggcgacgtggtgacgattgtgctgcccaaccagaggcgggacgccaggcggatgctgaagatcgcgcacatcgacgccaagccggtgacgcatgtgaccgccgagtccgacgtcgtggacgagctggtgggcgagacggccccgcgcgtggacggttgggtcttgaaggcaccggctccggcgcgaggcaagggttccgggcgcggcgggcggggtgacggcggccgtcgcgatggccgccgtggcggcgcccgtgacggtggtcgcaagcgcgacttccgcaaagaaggcaagcgctcgcacaggacgcgtgattcttatgattcgcatggctcccgcggttcccaaggcgcgcgtggattcggtgacgagggtcctttcgacggccgcaggagccaagggggcgaccacggttacagggggcgctcggaggacggcggccaggcccaaggccgttcccgcaacccccgctacggaagccggaatgaatcacgccgtggccgtgacggcggcaatggcggccagcgttcagcccggggcttccaacaccgcagcaaccgctccaagcgagccaacagccccttccgcgggcgctgatttcccttatcggtcctctgcgctgttggtccgatgcctttgattggactgctggcgtgtcttccgatatcactaaggaagtgattagggttcgtacgatacggacggcgtacccccaaaaccgccaaggcttttcagtcttggcggttttcgtttaggaggccgacttggataaaccattcaccggtatcacggatcaagtgcgcatactccaagggcgggggctcggagtggatgacgagccatcacacgtactggctagggaaggctactaccaggtggtcaacgggtataatcagccttttctgaaaacgaataggaaccagccggacaaatatagggatggcgtggagtttcgtcagatttacgcgctcttctgctttgaccgcgaactgcgtatgttggtgtttaaatattgtgagcaagccgaagctaagctgcggacggtgtgttcgtatgttttcactgagcggcacccagacgagaagcatccttatcttaacaccgcaaactaccgtagtacgggtgatagctatcataccgccgactggtacatggagagggtcggtgacttaattggcacgtttcggcatgtgattggtctgcagccttatgacaggcctctttttgagaaggactacatccggttttatttgcgggaacatggtcatgttcccctatgggtcttggcgaacagcctcagcttgggttccatgttcaaatttttctgctatcaaaccgatagcacaagaaatgccattgcccacgagtactcccggcagtacggttttgaccacagcggccaggcgcgtttctacttccatgatttgcggcggtgctacaaccatatcaaggacttccgcaatatatgcgcacatgatgagcgtctctattgcgctcgggtagatccgagcaaagggacttcggtcgcggttttgctgaaggaccttgacgctgtactcaccgcagagagttcgcgcgagctgcggacctcattgatcaatctggtgcagtccttgttcggccgggtacctgattatgtgtttgagcatattacttctggcatggggttcccggataaggctttcgcgtccatcacctcggatgtggtgaactaaggccttgccgccctggcaacagcgggcgcactttaggatcgttgggaatccggggaggtttcgtccgcttgccccgccgcgctcgccgcgcccggctcgtctgagccgggcttatccccggcgggtaagcgatgccgcaagtttcgtatggcttgctcgctgacggtcacggctccgccgatggcagccgtgccccattgcttggcctcgttcaatccctgtgtgctggtctggatgagcttgccgccagcttcctgggcggcgtccttccatgggcgcgcctcaatggcctctacctgcctgtcgagctccacggtccggctgaattcgctggcacgggcgcctatctcgtttgccagctccacgctcgcgggagcattggaaggatgaaggagaatctgccggttggcggcgtcgccggctcctttagcgcttgccgccagtcggtccacaatgcttgcgatgcggtcgagccggtgccccctggctgatttgagcgagagccggtgctggtcgagttcgtccggcgcggtcgtctgcacccggtcgagctcaagcatggcgctcgcgtcttgcagctgtacgctgcgcgctagtaccgcaagccattcctgggtggagacccgccctttcttgagggactgcaggaggtccctggaggactgtttggcgctcacggattcggcggtcgcctcaagctggcgtaaggcgtaagcctgggtttgcgcgatgatcagggccgaggactgtatcttctcccaagtgacctggtagatgtggccggtcagccggtattcatccatggcatcgtccacgagtatctcgacgccgatcatgttggagaggacggcgtctttctgggcgcgcaggacgtcatccaccttggcgtcgatcgtcgcgagataatcctgaatctcctgcatggccagctccatctccatctggagcatggcggttcccaaacctgccagcgtaccggggttgatcctcttgaatgagcctttttcgaactccaccagacccttgatgccggaccgctccttgacttgcaccgcgcccagttgcagtccgctccgcttgctggtcatgaggccgaattccttgattttctgggcggaatccgcggtgatcttggcccatcttccgcattcttgcgccatggtgcttccggcctggagcgtcactcccgcagcggccagcgcctcgctgtgcctggcgttgaactcctcggccttgagccctagggaggcgaggaaccgcttcgctgcttgggcgtccccgattgcgctgatgctgtcaccgtcactgacgatttgaatctcctggctcatccgcccctccttgcgagtcggcatcatccccgatgcacagtacctcttatgaatctaacaccgaactcatcgctgtgccgtcgacggagccgtaaacggccttgtggcctttccgcacggttttctcgagcgattcgaatgccgtctggcgcggatatggcccagggccgccgcggtgtcgctttcgaccgctgggcaaggccggaggcgcggcgagggtcccgctgcccaaccggatggcatgatgccaggcgaatcctgaaccacggtctccgtatttgagcgctacctgccgaacagggttctgaataagtccatgttcaaattcaggtcgtcatgggcgtctatgcggacttgccggtattcggccggtgtggacgaggtcttttccttgaacttcctggcgaactgctcggtgctgctgtagccgcactccttggcgacctcctggaccggcagggaggtcatgcccagcaggtcgcaggctttgtccaaccgtatgccgtcgatgtaatctcgcaaggtcagatccgtgacctcgtggaaacgtcgcgacagatagctcctgtccaagtgcagggctttggcgacgtcgccgggccctatgccctccgcgtggtgctcggctatgtagtctatcgccttgcgggccgtctcgtcgctggtcgccctgcttctggacagggtggaaccggtcgcgtgctcggtcagcaaatgcaggaattcgtatgccagcgagttcagtttcaggccgtcgctgaccgagcctcccgtgtaggagaagcactcggtgatcacacggaggaaggcttggttctggtccacgtggaagattgaatgggaaggccccagtccgatgctcgacagacacgatgaaacggctgacccgctgaaccctatccacaggtaaagccagggggtagtggtggacgcttggtattggaccggcgtctcgggcccgacgatgaacccgtcgttgcggcgcaggttatacttggtgccttcgcggcggacggtgccggtgccccccaagacgatgtggacgatgtacgtggagcgcagggccggaccgaacgagtggtccggatgcgtttcggatatgccgcatacggcgaaggagaggccgtccacgtctgtggaaggctggcggaggtaccaaatcgaattttccatgagtgccttcatcgattacggcattatctgcccccgcgcataggctttggccgtaattgcgcatcagtggggccatgcgaaacggtgtgggtcccgaccggtttagctggacccacaccgtaggtgattcctggagtttactggaatccggggcctagcgccgggcggtgaccttgcggcgcaaatcccagatgaacaatcccagcaggataaccgcgaagaccacggccaagaccgtgaacggcgcagttagggagtctgtgccgaaacctgtttcgacggcctgcatgaacagcggggagatgaaattacccacgttgcagccgatgagaatcagggatgtggcgaacgtgcttgtcttgggtccggtgatgtcgcccaaggtcgtgtagatgtaggggaagcaccaggagccggggatgccgatgagcatcatgcccaccaaggccaggatgaaattattaccggacatgctcatcatgatgttgccgaccatgtagaccgcaacacccatgtagagcacggacttgccgattgtgcggttcaggaagccgaacacgaaaccggcgaggatgcccaggatgggcatgagcgaaaggaagaagctggcattgtagcccgcccccttaatggcgacggcgatggatgggaagcgcaacgtggagcacagcgaatccagcaccatgaagaccgcgaacaggactaagagccagacgaaggggttgagcttctctcgagtttgcgcaccctcgcccgtgtcggattgcgaagcctccttggcggcatccacctggctggacgcatccgtggttggcgtgggatcggggaccacgaagtggaagatgagcgcgatggggaaggtgaacaggtaaatcgcgtagctccagtgccatcccagggtcagaaggaagccggcgaagaccgtcaggaccgactgtcccaggctctcagtggagctgcggaagcccagcatggtggctctggtgtcacctgtgtacagctcattgatgatgctgacggccaaggagttgtacaagccgagcccgcagcccaggaccaggcggctggcgaagatcagcgggtaggtcgagatgaccataggggctgcgccgccgatgccggccaggaccagggccaggcagatggtgtgcttggtgcctaggtgcttttccacccagctggacaggaggatgaacacaatgaccgccaggctggggatggtggacagcagctcgttctgcgcggtgctgatatgcagcgaatcgcgcatggcgggcagggcgccgttaatggctggcgcgctggtcagcatcagggaaatgcagagcaccgctgccttggtggcgaaactttgcttggatgatggcatgggaatgatccttgggttgattggtggttgtggtgtaaatcttggaatgatgccggatctggcggcctctcactgcgcttggaggacgaagagacgggagtcgaagtcgtgcgtcttgcccagcgggttgacccctccgagttcgccgctggcggcgtcggagtcgatcatgccgacgcgcatcagctcgtcgccacggaattccttgccgtctatgctggaaggcccggtgcaggagaccaggtactcgtagttcgggtccagcccttccagcttgaggcgcgtgaatgggccattgggctcaagaaggatcaggtagtcgccgataatggcggttttgcgatcctgggagaccaccatccaggcgcaccggctatcagtgtagggggagcgcaggcggtaaaaatcgccagtgcgcaggatgccgcggtacttcttatagaaggccacctgccggttcacggcttccatctcgtcatcgctgagcttggccaggtccagctcatagccgaaagccccgaagagcgctacattgccgcgcgtgtggataggcgtgattcgctcggtctggtggttaggcacgaccgagacgtgggcacccatcgaaatcggcggatagaagtagctagtgccatactgggtcttcattcgttccacggcatcggtgtcgtcgctgcaccaaatctgcggggtgtagtagagcatgcccatgtcgaaacggccgccgcccgaggcgcatccctcgatgagcagctccgggaacgcgtcaagcaggcgctgcatgagctcgtagacgccgaggatgtaacggtggcggaactcgccttgcgcgtcggggccgcgggtcgcgtcgaaggcctctgagacatagcggttcatgtcccatttgacataagagatgttcgcgctgctgagtatgcggtacatctgctcgtagatgttgtcgaccacttccgcattggcgaagttgagcaggaactcgttgcgaccgtggttcatatgccgtcccggtgtgtggatggcccagtcggggtgcgccctgtacaggtcggagtccttgttgatggtttcgggctcgaaccacaagccgaactgcatgcccaggccgttgatgcgcttggccaaacccggcaggccttcaggcagacgctcacggttgggggtccagtcccccaggcccgcggtgtcgtcgttgcgggcgccgaaccatccgtcgtccaggacgaagagctccacgccggcctccttggccttcgaggcgatggcgaccagtttgtcttcgtcgaagtcgaaataggtggcttcccaattgttgatcagcacggggcgatcgcggtccttccagggggcgcgcatgatgtgttccctggccatcctgtgggagtcgcggctcaggaggttgaggccctggtccgtccagccgagcaaggcttcgggggtttggaagctttgtccgggcttgagccgccaggagaagtccgcgtcgttgatgcccagctgaagccgggccacgccataggagtccacttcggcatgcaggtcgaagtcgcccgagtagacgaaggcgagccccagcgcttcgccttggctctcgccgcaatccgggcgggagaagagcgcggtggggttggtgtagtggctgctggcgttgcgcagggactccagttgctggatgccgtggtggaggcgctgggtctgcgggtggcgctcgcgggcccaggcccctgtgaattcggtcatctcgtagtcgctgtcgggcatgtcgatgctcaaactcatcatccgctcgatcagcaggtcttcctggccggcgttgttggcttgcgcggagcgggcgatgatggaactgtcgctgaagatggtgtagctgagggtcaccacgaggccggtttgggcgtctttcagcctcagcagcaaggtggtggcttcgttctcctgggcgtagctggcaggcagcccttggagggaaggcttgccgtcggtgatttcgtagccgtcgtactgcaggtcgatcaaggtggagccgttgggctggaggacgctgatggcgggccggcggtagtcgccattgccgtattcggggtactcctggcgcaggtggtcgagcgaataggtcaggtcaccttcaatccggcaggtggcggtggaccggtgctggagctccaccagatggccgaagtcctcgcggtcgcttaccgcggccccgaagtagaggttcaggagcttgccttccttgtcgaccttcatgatgtagctgatcaggccattggtcaggtggaattggcgttgggattcgtgaacgatgatccgcggttcatgggcttgggggtctgactgtgttgccgtcatgctcgctctctccttcgagtggtgatgagtggtctccttagacggagtgcgactgtgccgttcaggaccccgtcccagtccttaatcgtaaaaagcctccaaggctgtaaaccgcggaatatcaggtgttttgtggcctgctgtagttatttttgtgaccttccagcaggaaggggccaggtggggttcctcgcttcttgggggcctgcattcgcgatttgaaacggttttcgcgggagtccgtcgggtcccgtttgagggcgtcggccgggtttccggtgactggctatgtcaaaacttgacggagcgcggtctacaaaattcctgtgctttcgccggtgcgctggcgggcgccagtgagcatgggctggctctggtcggctctggagcctggttggagtagttcgaactgggggccgtattcgatgagggcgacgagtcaatgttttgtgaggcgggggaggtgattcactgtgtggcccaggtgtcttcacaagcttgctgggaggtgttcgccgtcaactcgatagcgttttcggttcagcggctccgagtccatgccaccgccgtggtcgttgcatgaaatatccaagatgagcgtggctcgccgccaatgggccaagccaggaatgggaatggccacgtctccgaccggggtatcggcgtttgcgcgtctccacgtacctatggaacgcgcggcttccggcgggttggacagcgccgtgtctgaacgctggagcgactatacggcccctcggtttcgacgcacgggcgctgaggggtgcctaatcggtgcggctaaggggacaggatttcagtggcggtttggcggtctaccaccaagtgagtgacgaagccagatttgagcgttacgcgcagggcccggaccttatgaggtcggctggcccagggttgctttcccggttgtggcctgacgtggacgggctgtttttggggcggttcgtccacgattccgcggcgttcgtctccgtggcgcgtgaggctgtggcgctgtcctaacggttgccgtggggcacagtcaggggctggacgcggattgggtgtgaggaagatgactgtgagaatcgtcatggtttaggggtgcggaatggcggaattccgcggcttttggatgatacggtgggctcgtcgtaaagattcaattatcaatgaggttgataacgccatgtcgaaaatcaatgctgcggacaagatggtccaggtcatgcaggcctggggtgtcgacaacgtgtacggtctgccgggcgattcggtggacaccaccgtcgaggccctctacagggtgcgcgacagagtcaagttcacccaggtgcgccacgaggaggtcgccgcgctcgccgcagcggcccaggccaagctgaccggcaaggtgggagtctgcctctcgatcggcggtcctggcgccatccacatgctcaacggcttgtacgacgcgaagatggaccatgtgcctgttgtggccattctgggccagattcagtcccacctgctcaacaccggctactttcaagaagtagacctgcccaagctgtgcgacgacgtggccgtctacaataagctggtcaccggtcccgagaccttgccagccgtgatggatgaggccatccgcatggcttacctgcaccagggtgtggctgtgctgaccatccccgacgacgtgcccaaccacaagatcgaggacaccttccgccccaccgctgacctcttccgccagcagcacccggcaatcgaccctgccgatatcgacaagtcgctcgacatgatccgccgggccaagaagccggtcgccttcttcggcgtaggcgccaagggcgcgcaggccgaggctaaggagttcgtggagcgctactccctgcctttcattcagaccatgccggccaagggggtcatcgacgacgaccacccgaacgccctgggccaggtgggcaagctgggcaccaagcctgcttacgaggccatgttcgacgctgacctgctgattctggtgggcacggactatccctacgccccttacttgaatggcaaaatcccggccatccagattgagctggagcccacccgcatcggcaaacgccaccaggtggaggtcggcatggtggctgacgccaaagacgcgctgacccagctgaacgcccggggtgagaagatcccggagacagactggctcaaggcctgccgcaagaacatgggcacctggcgcaagtggatgaaggacgtgaccggcaaggctcataagggcgtgctgccctcacgcactttcactaagatgagcgaaatcgcgccggacaatgccgtgtggtccgtggatgtcggcacgtccacctccttcggcgcgcgtttcatcgatgtcaagtccacgcagaagtacgtcatctccgcttggctgggcactatgggctgcgccctgcccgctgctatcgccgccaagcgtgacatgcccgaccgtccggtctacgcggtatgcggcgacggcgccttcgccatggtcatgcaggacttcgtgacggctgtcaagtaccagctgccgatagtggtggtggtcctgaacaaccacctcctggctttcatcgagtacgagcagcagtcggttggacagcagaactacggcatcgacctggcggacatcgacttcgccaagttcgccgaggcctgcggtggtatcggcgtgaacgtgaccaccgacgaggagttcgacgcggcgatcgagaagtacaagaaccccaccaagccggtgatcatcaactgcgcctccgccgatgaggccccgctgcccggtaagatcgtctgggacgaagcggagggctacatgaagttcggcctaggctacatgaaggagcagttccgcatccccgagctgccgcccctgcgcgagctgatgcgccagttcctctaaactccggcaccctcccgccactgacgacttcagggccgcaaatccgttgaacgcgggttcgcggccctggccataccccgcaagcccgcgctcccgccgcaagcagcccgaataggaaactataggaaactatatgtggctgtggggcggtgcgggttagaggtggaggactatgtgggcccagctggtgatcagggcctcgttgttcacgccggtgactagctgtatcgcggttgggcggttggaaccgacggggagagcgggggcttggctgaggtggagtttgccgttcgaggccaggctgacctgggcatcctccacgctgaccaggcttggctgattcagggcggcgacggctatcaggtcgtggagcctgtcctgttcccgctagaaccgccagggctagccgctatagcggcgtcggcggcgcaaaacgttcgcattgcacctccagaccggccccagaaagcgagtaagaacggccaggtgtgcgattgctcgcgcacctttttgcgtaagtggcgggcggcgaattgctgccctcaccggttaaggtgaagcagggcccgtaactttcgcatagtccaccgtcgtgttaaaattccacgccgtccgaccgcgcctatgagaagaaggggcaggaggcatcaggaaaaccgcatgaaaaaagggctttggcggtgaagccaaaaccctgcttgtggagctgatggtaatcgaaaccacgacctcttcgatgcgaacgaagcgctctaccaactgagctacagccccaagcattgcccgaccgtagccgggcaactcagctactttaacgcgaaggagggtcaaacgcaaaacttaaaaggcggatggcgcgcctgggccataagacggactcgggaggcggcttgcaggtgctggctgtacggcggtctgcgcggcggtctgcgcggccgagtgccggctttcgcttattcgcctggctgggcggcttcctccagggcgggggaggactttttcctgccgaacttggccttgaataggccgatgaccgtgggcaggaccgaaatcatcagaatcaggacgatgaccagctcgaagtgctcctggacggcggggatgccgccgaagaagaagcccagaagggtgaagagcgtggaccagaccagaccgcccaggatcgagaagggcgtgaaccgggaccacttcatgcccgaaatccccgagatgaagggcatgaacgtgcggatgaaggggaagaaacggcccaggaagaccgccagcgggccccacttgtcaatcatggactccgttttggcgatacgctccggggtcattgacttcaccttgcccgagcgcaggatggcctggccgaagaaatggccgatgaagtagttgctctggtcgcccaggatgggggcgagcatgaccaccggcaggaggacgtcgagccccatgccggacttggggtcgtgggcgaagaccccggcggcgaacaggagggagtcgccgggtaggaaaggcatgaagaccacgccggtctcgatgaagatgatcaggaaaatgaaggcataagtgggcaccaggcccattgcgatccaagaggcgatagcggagcgagggtccttaagaagaccgatgatccaattgataaagcccattgcggtgcaatcccatcattttgcggctcgctcgcgctgattcgcgtggcgtcagcacgccgaccattgacaaaccgtactcactctagcaaccgttgccgtcaggacgagcggcgggatgcgagcctacgcgaggggattacaagtgaacggagcgcggggcgaccctgcatcaaatccaagagggcagccacatgtggatggcccagaaccagtagggcaccggtatggccgtccatatcggatagaagaagagcgaaaccagtcccagcgtccacaggacgattgagcaggtgcgcttgtaggcgggggcggacaggttggtgcgcagccagtccgccaggtagcagatggacaggatcatccacggaaggatgacgaccgcatagaaggtgaaggtggtgcggttcaagtactggacccagggcaaccagccggccagaagaccagagatgaccgccaagtagcgccaatcaccccgcctgaagaggagggtggtcagcaggcccaggagcaggcagacgcaagccagccaccacaggagcgggttgcctagggacgtgaccgaggccacgcactcggagcctggggccaggccgcacaggcccgggcggtcgctcaactcatgccagtagaaggatgtggggcggatttgcaggggccatgtcagcggattcgccatatagggatggggggcgtccaggctggtgtggaagcgccacatctgccggtggtactcgaccagtgagcgcaaggctggcggcaggaaggtgaggccctggacgggatgggagatggcccagttccgcatgtaggcatccgggtggaggagccagccgctccaggaggctaggtaggtgccggcccagagggggaccatataggcggcggtgggcagaccgtctttgaacaggccggcggtcagccagccgcgatagcccgcttgccggcgcgcgtaggcgtcccacaagaccgagattaccgcgaataccgcgaaaaagtaggcgccggaccacttggttccagtggccaatcccagcaggatcgcggccgccaggcgccaccaggaacacgcgatgaaggggcctgaggagtccagcaccaggcgggaacgggagtcggcccggcggcggcccccgttctgcctcctgctctcgccccatttccagcgcggcagggcggcggattcgatgaagttggacgaacggttcgccaggtcgcgctcgtaggcttcatccaggcgggcgcgcgcccagtcccggtgtgcgagcagacaggcgaaagcggccagggcgaagagcatgatgaagctgtccagtaggccagtgcggctcatggtcaggccgaggccgtcgatggagagcaggaagccagccattagcgcgattggcaggttatggaagagcctcagcgccacccggcacaggatgaggaccgccagcgtgccgaccagggccgtggccgcccgccaggcgaacgggttgcctgcgccgccgaagagtttcaatcccacggcgatgcaccacttaccgatcggcgggtgaaccacatattcggcgctggacagccacaggttcgtgtcgcccgaggcgaagagctggtcgattggcaggtccttggcgcccgcccggtccggccagtcgcgggcttcgccggtcatcagcatggtccaggcgtccttgacgtagtaggtctcgtcgaagacgaccgcgtgcggcgagccaaggcgcacgaaacgcaggatgccagcgaacaaggccatcagcgcagggcccagccagcccagcgtccgttgactgaggcggcggggtccagccaggtgcagggcccaggccatccggtcgcgcagcatggcccaccgggcgcgcgccagcagacggccgccggagtgatgctgcgaagaaagaaggtctgagctgctcatcatctccagcctaggcgatactggaagcatgaacgaggtgcagcgcgaatcgacacaagacatgacagggcggaagcaggatgggccggagcctggtggcggtcggatgccgggcgaggtctcgaccgcgggttcggacgtgcccgcaggaaccgtggtgctggcggccactccgatcgggaatacggccgatgcttcccagaggctcaaggacctcttggcccaggccgacgtggtggcggcggaagacacgcgccgcctttacgacctggccaaccgcctgggggtgcgtgtgggcggcagggtgattgcctaccacgaccacaacgagcgtcgccaagccgacccgctcctggatcaggtggaatccggggcctgcgtgctggtcgtttcggacgcgggcatgcccacgattaacgaccctggcctggccattgtgcgccgggccatcgagcgcggcctgccagtgacttgcgcgcctggcccatcggccgccatggacgccctagccctgtccggtctgcccaccgaccgcttctgctacgagggcttcctgccgcgcaaggccaccgagcgtcgccagtacctgcgcactttgcagggcgagcggcgcacgatggtcttttacgagtcgccccgccgcctggttgattccgtggatagcctgctggaggctttcgggccggatcgcgcgatggccctgtgccgggagctgaccaagacctatgagcaggtggagcggggcagcattggagaaatacgtgattatatccagcaaaatccgccccggggcgagatagtgctggtcctggccggcgcctcccgtgaggaagccgccgcagccgctcctgaggtcctctccgaacaggatttggcgaggttggcgttggagcgctcccggaaggcgggggtgcgggtcaaggacgccatcgcccaagtggcggccgaacaccccctgccggacggaacgagccccaggcgcaaggcggtttacgcggcggtcctggccctgagggacgaaggggagtgaggctcggccggttgccgttcatgccctcgtgggggtttctgggggccgttgctggtcttcggcgattagtgccggtcagtcagcctcgttcctccgcttgtccaggtagtccatcaggaggcccagggcctgcttgacgcctggcccgcccagttgggagatggcctccaggagttcgggcgaggctcgggggttggcggccaaccaccggcgcagttccggcagctcacgggctatgtaccacaggactgccggatcggtctccgggtcgcaagccacggccggggtcaggaccaggggtggctgtggcggagcgggcccatcgctggggcgaggtccaaggctcgcggcccctgcctgcctgctggaggggaccattccttcttgtaaatacttgagtttgtcaatcggattaccggtcttcgctcgcccgaatgacttgggcatcccaccccggcgcttgcgggagggcgcgtggcccagccagcccctcacaagatgtcccgtaagagatggaaggtccggacgccgaccgcatgtcctggccagcggggattggcctccagcaggttcaggcaggcgccgcaggtgacatggtaacgctccatcagggtgtggaggtaggccaacttgcggtcgtcgccatcgctgcctcgtggcgcgtcttcacaggccaggtcgcatgcggtgcgcaagggggatgtggcccacagatcacccagctgcatcagatgctcggtcggcagacggcggttgtgaacgcgcaggttgtggccatagaccggggcgcggaagtgcgagttggagacgatgtcgaggtggggagggaagacgccacccgtccaaatccagccggccagggcattgcaggcggccgctccatagggcagcagcggtgtcactatggatgcgcggccgaagatgcccgtcgcgcgctcgtgcaggtaggagcacgaagcgtccaacggctctaccaaacggcgttgcgtcagcaggcgcatgctgttggggccgggcagctggctcaagtggaccaggttgggcaggggttgttcggctggttgaccacccatccggctcgcgggtcgcaggcgggcgggcgcggacttcggcgtggtcggcctcgcctgctttggcccggtccgatttggccggattggtttgacaggctccaagcccaggcggtcgtcaagggtgggctggctccaggagcgtctgctcgcgggcgctggtgaaggttgcgcggacggtgggcgcgcaagttctggccgcgcggacgccggacgcgcaaaggccggtcgcacgggcgctgcaagccgggcttctctcctgcgggtcggtggtccaccgtcgcggggggtcgcagcttgagcgggagcaggggcgggtcgttccattgtcgcggtcccgtgtccggattccgcttgtcttgtcagtgtcatgcgaagacactatgcgggctttcggcgtggctgccagtttgatcccgtggctggggagcaagtggatgatacgggaggcatccactttttcagggggcaaaaatgtgcatggatgcccatttccgtccactggccccagttccgcttatgaatccaccgctgggggcaagtggataagtggcgggtcaccgatgcttccgggcgctcgcaggcgcgagtttccgccatttgtaccccgaggccgataatctggcaggcatgagcaagattcttgtatccgtcgcctggccctacgcgaatgggccccgccatatcggtcatgtcgccggattcggcgttccctcggacgtgttcgcccgctaccagcgcatgaaaggcaacgacgtgctcatggtctcgggcaccgacgagcacggcaccccaatcctggtggaggccgaggctgagggtgtgagcgcccaggagatcgccgaccgctacaaccgggtcatcgtcaatgacttatgcaagctgggcctgtcctacgacctcttcacccgcaccaccaccggcaaccacgagcaagtggtgcaagagctcttcaagcagtgcctggataacggctacatttacaagggcacgcagaaggtggcgatttcgccctccaccggccgcaccctgcccgaccgatacattgaaggcacctgccccatatgcggctacgagggcgctcgcggcgaccagtgcgacaactgcggccacgagctggacccggacgagctgctcaacccgcgctccaaaatcaatggcgaaaccccgcgcttcgaggagagcgagcacttcttcctggacctgccagccttggcggaggccaatgaagcctggctcaagacccgccagggttggcggaccaacgtgttgaacttctcgctgggcctcttccgcgaggtcaagcccagggccatcacccgcgacatcgactggggcatcccggtcccggtggacggctggatcgacaaccccagcaagaagctctacgtgtggttcgacgcggtcatcggctacctgtcggcctccatcgagtgggcccggaggcagggacggccggaggcctggagggactggtggaacgacccgcagtccctgggctactactttatgggcaaggacaacatcaccttccattcgcagatttggccctccgagctcctggcttacaacgggcagggctccaagggcggccagcctggcgagttcggcgagctcaacctgccagagcaagtggtggccagcgagttcatgactatggagggcaagaagttctcctcctcgcgcggcatcgtcatctacgtcaaggacatccttgagcgctaccaggtggacgcggtccgctattacatctcggtcgccggcccggaatcctccgactccgacttcacttgggccgagttcgtgcgccataacaatgaggagttggcggcgtcctggggcaacctggtcaaccgggtggccaacctgctcaacaagaatttcggcagcattccgccggttaacgaggccaagttggacgagcgcgaccgtgccttgcttgaccagtcccgagctgcgttcgacacggtgggcggtctgattgaccgccagcggcagaaggccgccctgggcgaggctatggccctggtgggcgacatcaacaagtacatctccgccaccgagccttggaagatcaaggacgatccggagcgcctggcggcggtcttggtcactggggctcaggccgtgtccgatgccaaccacctgctcgcgcccttcctgccccactcggcccagcgggtcttcgaggctttgggcggccagggcgtcttctcccccttgccccgggtggaggaggtcgaggatttggataagcctggcttccagtatcccatcatcaccggcgattaccggctgggcgagactgtgcacccttggaagagcgagccgctgaccaccggcgccccggtgcccaagccctctcccatcttcgccaagatccccaaggaggccgtgcaggaggagctggaccgattccaggccgaattggacgagcggcaagccaaggcccaggcccgttacgaagccgaacaagccaagcttcagtcttgaccaactagcgccgtcccagcagcgggtgcgcgcggacggcgcttccggcgcagatgggggggggggcgaggtgatgcggcttgcatgcaaggcgatgactcgcggttcagcgaaatactggcttgcggggatgactggcttgttggtcctgctagccgctacctgctaagtcttcggtggggtcgcaggttgccttcacgcattcaatactaaattcttaggggattttgaggttttgcccccgtggcatgcaggcaggcctgcttatatatgaattaccggcggagcacacagccggtgaggttccacttgaaccccataattgaatctccttcttctctctcttctcaaagcccggcggctccccccgccgggcttttcttcattggcgcgcggacgcgccgcgacgggctcaaacttcgtttaagcgtgaaccccctggtccttggcgcacttgtccagcacgtcccgcccctcgcttagcccttggcccggctggcttgcgcatcttgcggcgaaatcgggtcgatcgagctggggcctggaatgtccgcatcctccaagagtcaccccacagctgattactgggctctcgcgcgcccgcaccatgctggcggttttggtcccttgccttgcggctacagggttttgaattccgggcagcacggcgcgcctgaggttggcggttaggggcggtgggggctggcgcatagaatcgagcgtatggagatttctcaagctgaggccgtgctttttgatttggatggcgtgctcgtgccgaccgtgaaattgcatcggcgggcctggaaagaattgttcgaccaagtgctgccggagggggcagcgccttacaccgagcaggattacttcgcgtatgtggacggcaagccgcgctatgacggggtggccggcctgctcaagagccgcgacatccacctgccctggggctcgcgcgacgatagcccggacaaggagaccatctgcggcctgggcaaccgcaagaacctggttttcgagcgcatgctggagcgggagggcattgagccctaccccgatacggtggacgttcttcagcacctgctcggggcaggcaagcgtctggctgtggtctccagctcccgcaacgcgaacaccgtgctgagggtggctggcatccgtaacttcttcgaccgggtcgtagacggcaatgtgcgcgccgagaaagggatcaagggcaagcccgcccccgatacctacgcattcgccgcccagctcctggaggagcgggttgaggattgcgtcgtggtcgaggacgcactgtctggcgtggcggcgggccgttcgggcggcttcggcttggtcgtaggcgtggaccggggggctggccgggcgaggcttttggaggcgggcgccgaccgggtggtcagcgaccttatcgagctgattgaaagcggcggccggcgctccggtttccaggaccgggagcggcttgaccccaaggactatccgaacgacccgtgggggttcgaggagcgtcgcccgccccgcccggagagcgccaccctcttctccgtggcgaacggcaacatcggcattcgtggggatagcggtggttcgcgaggcttgggcaatggcacattcctgagcggtttccacgacacatacgacatcaagcacccggagagcgcttacggttacgcccgtgtgggccaggtcatccaaggcgtgccagacgcggccggcttcgttctgcgcgccgacggagcccccctggtcgaggctgagtcctacagccagcgggtggatttccatacgggcgtggccacaatgaccaggctttaccggctggccgacggggcgcggctgcgggtagcgatggaccgcatggcctgcctgttcgacccgaacctcgttgtgacccgcctgcgggttgagtcgccggacagggaggtcaaggtctgcgttgatgggcggattaatgtggaggcgcccggcctggtggccagcgacgacccacgcaagtccacccttataggcggctgcggcattcacgaggtggttgacaccgcccccgccatctcgctatccccgaaccaaccggccgccacggatgctgagagcctggtccgcgcaggcctgatgcaggattcgggcgcgcccacggagtcctccacctcgggttgggagagccatgtcttccgcgccaacaactcccgcctgaccatggccatggcaatcagccagtgggtcgatgagaacgaaggggacaagaacggtttcgacggtgcttggcggcggctgccgggccgcatctgggagctcacggctcgtcctggctcgccaatctgcctggtccgttacgtcgcttaccactcttaccccctgcaccccttgggcgtgcgccggggtctggcggtcagctcggcgggcgatgacgcccaccggctcttggaggggtgcgcggaaaccctgtcccaggccgagcagtccgggccggcggcgcttttcgcccgtcagagggactggttggatgacttctgggagcgcgccgacatcgagatcgaggacggccatgaccccgagagcgaccgtacgcagcaggtgacccgctgggagctcttccaactggcccagtccacggcgcaaatcacgaacggtgtgggcgccaagggcttaagcggcactggctatgacggccactacttctgggatacggagatttacattctccccttcctgatttacacggatccccagcgggctcggctcctgcttcacttccgctatcggatgcttccttcagcccgtcgccgggctgccacgatgggcttgaacggggcgctcttcccctggcgcaccatcaacggcgaggaggggtccgcttacttcccaaccggcaccgcccaataccatatagacgcggacatcgcctacgcggtcacccagtactgcctggtttgcggtgatgacgactacttggcggacgaggggctggacctcctggtggagacggcgcgcatgtggctttcgctcggcggcttccagcctgacggacgcttccacctttacagcgtgaccgggcccgatgagtacacggcgatggtggacgatgacttctacaccaaccaaatggcccggttcaacctgcgctcagcgtgcatggccatccaagacctggcccaacgagacccgaagggcctgaaccgggctaaggagcgtctgggcttggataagaacgaattggagcggttcggtgaggccgccgaagccatgttcctgccttacgcgcaagaggagggggtccatgcccaggacgctcagttcatgagccgtcccaagtgggacttcgagcattgcccggcccgtcccctcctgctttactaccacccgctggccatctacggccacaaggtattgaagcagaccgatgtggtcctggccctctacctgctttcctcctggttcgaccccgaaggcaagcgcgccgacttcgactactacgacccgctcaccaccggtgattccacgctttcggcggcctcccaagcgattatcgcttcggaggtggggcaccaggatttggccttgcgctacttccaggagtccctgttcgccgacgtgatgaacctgcacgacaacacgatcgacggcgtccacctggctgcggcgggcggcgtctggtccaccctggtctgcggcttcggcggcctacgggacactggcggcacccacatcgagatcgacccgcgcctgcccaagggttggaagtccctgacctaccggctcacgattggcaactcccgcgtcaagttcaaggtcacctcccatggtgtcgagaccgagcgcctggacggcccgtccctgaccctgcgcatatccggtcaggaccgccaggtttgagggtttccggcaagggccgcacccgctcctagactggtcggcatgagcaaacaccatcggaagcgtcagtgggcgccggccccgcaggagttgccggacggggtgcgggtggcggatgaccacacgcacttggcctcagtgccgccgttcgcggccgagctggaccggcaggcgcgggagcgtgggcaggatccggtcccggtctacagcgtcgatcagatgattgaccaggctcaagcggtgggcgtcgaagcctttttggatgtgggctgcgaactgctcaatctggaacgggccgtgcagctgtccgccgagcatccaggggtggtgtacgctggtctggccatccaccctaacgaggccgtattgcatgggcaccggggtgtccccgggcctgacggactgccggtgcactaccagacctggcatgacatcccctaccaggaggcgttctcccgagttgctgagctggcccaagcccacccgcgcgaagtggtggccataggcgagaccggcatggacctgtaccgtacgggagcggcggccgaaggcatccagcgccaggccttccgcgaccacatcgctttggctaaggagctgggcctgcccctgcagattcacgaccgtgacgcccattcccaggtgattgagaccctgctggccgacggggcgcccgagcgcacggtcttccactcttactcaggagacgcggccatggcccaggtggccgcagagcatggctggtacttatcgtgttcaggcagcgtctcatacaagggcaatgagggcatccgtcagtccctgtcggtcgtgggcctggaccacatcatggtggagacggacgccccctatctggcgcccatgccctaccggggtcgggccaatgccccttacatgattccctataccttgagcgcgatggccgatgcactggacctgcccttggagcaagtggcccaggccacgagggagaccacccggcgggtctacggcttctaaggggacggttggccgggctgtgcgccgtcgaatcttggccgccgattgcgtatctggggataaaaggtgctacggtagtcgtcgcgtgcgtatggagccatatgggccctatgtgcgctataagcgttaacatagagcattaagcaggccgtgggccggccgatggagggctgcatgtccaatgatcagcgccgcgcgtcccgagaagagggcgtcgaggaagcggatgatccgccccgcttatcccagcagtctgctcaggcggacgctcacaggacgggcaaaacggcccgggagcggcagccccagcccgcgcagctgactcagcaaactcagtcgccgcggcaaatccaacaggattccatcctactctccgagtcgattaccaaggcacccaagctttcgaagaagtcccgcacccgcgaggaggaggccgagctcaagcgtgtccggcgcgaggcccagcgcagagccaggcgcaagcagcgccccgcccgtggccccctaggccgctggtggcgcaaggtgcagtcctcgcccgacagggtgaccataggcatggcggtcgtcgccctcggcgtggtttacggtgatatcggaacctcgccgctgtacaccctgcaaaccttcatcgccggccagggcggcatccagaacgtggaccggtccgcggtgctgggcatgctttccttggtcttttggtcgctcacgctagtcaccaccgtcaagtatgtgctggtggccatgcatgtcgacaacaagggcgagggcggcatcttcgccctctacaccctggtgcgcaagtacggacgctggctggccattccggccatgctgggcggcgccgccttcctggccgattcggtgcttaccccggccgtgtcgatctcctccgccgtggagggtttgaggaccataccagccctgacctccgttttcaagagcgctcctaacctgacgatgataatcacgatgattatcgtcctggtcctgttcgcggtccagtcgcgcggcactgagcgcatcggccacgtcttcggcaccgtggtcatggtctggttcgccttcctggccctgatgggcctgtaccgcattcaaggcgactggtctattttcgcggccctgaacccggtctatggcattgaattcatgttcagcccgcacaatcctgtcggtctggccatcatgggcacggtcttcctgtccaccaccggcgccgaggccctctattccgacatgggtcacgtggggcgcggcaacatttacgccacttggcccttcatcaacatcgccctggtcttcaactacttcggccaaggcgcttggatcctgcgcaataccgacaacccggccctgcgcggggtcaccgacatgaaccccttctaccagatgatgcccaccacggtgcgttatcctgcggtcatcctgtcggtcacggccggcatcatcgcttcccaggccctgatcaccggcgccttcacgatggtctccgaggccaccggtctgaactggatgccccacctgcaggtgcgctacccgtccaggacccgcggtcagctctacatccccacgattaactgggtcttgtgcgcggccacgtcggctgtgttgctgattttcaaggattccgagcacatctccgccgcctacggtctggcgctgacgattacgatgatttcgaccaccatcctcttgatggtccacctgtggtgccacggtcgcaaggtcttcgcggtggtcttcgcggtggtcttcctgaccattgaccccctcttcttcctggcgtccatgaccaagttcatgcacggcggctggttcaccatgctcctgaccgctgcgattctattcgtcatgtacacctggatggaaggcaccaaggtcgagcgttcccagcggcggcatatgacgcccaaggagtgcctgccggccatggagatgctccacaacgacttccgcatcccctacttcgccgacaacctggtctacctgacctcagacaacgagatgcgccgcctggacacggacatcttcttctcgattttcgccgaccaccccaagcgggcgcgcgcctggtgggccgtctcggtgcagaccaccgacgcccccttcacccgcgaatactcggtcgagaacttcggcaccaactatctcttccgggtacggatgcgcctgggcttcaaggtggaccagaacgtggccacctacctgcaccagatcatgcacgagctgatcgactgcggggagctgccccggcagacctccacctatccgaaagtggacgaagacccgcagatcggcacaatcacctacgtcctgattcacaaggctttgatgcctgaatccaaaatcaccactaggggagcggtttcgctcacagtcaagtatgcgatccgtcatatggccggcaaccccgtcaagtggttcggtttggccccctacaatccgttggtcgaagtgcagcccctcttcgtcaccactcgttcggttccgcgtctgaaccgggtgtccttgcccaagtctcataaaaaaaagtgggccaagggggcgaagaagccaggggcccagcaggccaagaccggcgccgggcaggaggccacgcaggctaaggctggggcctctgcagccgctgctacgaccgatgcggtggatgagtccgcggaaaaggtggagggcaaagccaagggcagggagcgtacgtctgagcgcaagggtaagggggcgaagccttcgaccgccgaccaaggcaactgaggcggaactgcctggtctctcctgctcacagctgatcaagtcccggggacagcctttgcgccccgggacttgtcgtttggattgggatagactcggaagcgattcgcaagtgatgaaccgggtccgcccttgcaggcgtgcccctgggaaaggtgtcttcatatgactgaagctgtagcgaacatcggtgtagtgggtctggcggccatgggggccagcctgtcccgtaacctggcccggcatggcaacacggtggccgttttcaaccgccactactcgcgcgcgcagaccctgatgaccgagcatggctccgaaggtaagttcgtccccgctcagaccctggaggagttcgtgggttccctgacccgcccgcgcacggccatcatcatggtcaaggccggtgagcccaccgacgacatgatcaatgccttagccgatttgatggagcccggcgacatcatcgtcgacgccggcaacgcttacttcaaggacaccatccgccgcgagcaggccatccgcgcccggggcctgcacttcgtgggctgcggggtctccggtggcgaggagggggccctgctgggtccctcgatgatgcctgggggcaccgaggaatcctggaggaccctgggaccgattttgaagtcgatcgcggcggtggccgagggcgagccatgcgtgactcacatcggcaccgacggtgccggacacttcgtcaaaatggtccacaacggcatcgagtacgccgacatgcagcttatcgccgagtcctacgacctgatgcgtcgggggctgggcctggagcccgaggccatcgcccaggtcttcgaggagtggaataagggtgatttgaactcctacctggtgcaaatcaccgccgaggtgctccaccatatggacgccaagaccggtaagcccttcatcgacatcgtcaccgaccaggccggtatgaagggcacgggcacttggacggtgcagacggccctggagctgggcgtgccggtcacgggcattggcgaggctgtcttcgctcgcgggctttcctctactcccgccttgcgtcaggaggccgaggccaagggcctaggcggtccccaggccgagggtgccttcgcggctttggccgcggacccagaggagcgcagcgccttcatcgaggatattcgccaggccctgtacgcctcgaagatcgtagcctacgcccagggctttaacgagatggaggaaggcgccaaagtttacggatggacgctcgacctgggtgccatcgcccgcatctggcggggcggctgcatcatccgcgccaagttcttgaaccgcatctccgacgcttacggctcgggcgagcagttcggctccctcctcttcgatcccttcttcaagaaggccgtggagggcgcgcaggactcctggcggcgcgtggtggctcgggcggcccaggctggtttgcctgccccggtattctccagctccctggcctattatgacgctttgcgctcccgccgtctgcccgcagccctgatccaaggccagcgtgacctcttcggcgcccacacctacgggcgcgtggacgagcccggtgccttccacaccctgtgggctggcgacaagtccgaaatcaaggcctgagcgcctatctcagttctagctgggtcggagcgatggtgggtcaaatcgttaagcccaccagtcgcgccggctgtggcttagcgcctggaggactccctgacgacgagtttgtaattggctgtcatttgctgtggttccagatgggcctgtggctggtttatgcgttccataagcatgccgacgcttttggcagccaagtcatccaagtcggtttgcacggtggtgagtgacggcagggagaggccgccctctttgatgccgtcgaatcctactaatgccgcgtcttgtggcacgtacacctgtcggtcggcaagtccgcgcatgaatcctaaggccagggaatccgtcatgcagaaggccccatcgaactgacgcccggagtctatgagctggtgggcgatgtttcgggctgtgtcggggtcccagtggtcggcattgatgaaggtagtgtcgtcaaacgccagttccgcctcctgaaaagcttgcaggcagccacgcaagcgtaaggtctttgtagtattcgcgtttgccgggtcattcatggtcgataagctggcgcctatcactatgatgcgtctgcatccgattgagatcaggtgcattacggccgtccgcgcacctgctgtccctgcggtcatcacgctgtcgaaggcagggtggagggaagggtcgtcgagcaggaccatcggctttccgtctgtcagcgcccgcatttcctcattgctgatggatcctgggctgaagatggtgccgtcgcataactgactggtgactctttgcaggatggagatttcatttcgttttgatatcgaggtctgttggatgatcgcctgcatgccgtatgcgttgattttccgcgagagggtggcgctcatctgggaagggtaaggtttgtcgagctcaaagatggcgacgccgatgatgccgcttttgcctgatctcaagcttctggcggataggttagcggtgtagttgagcttgcgcgcagcttcgacgaccttgttcctggttgattcggctattcgggtgtcgccgcgcagggcatacgaggctgtggctctggagaccctggcctccttggccacatcgctcatcgttaccatctgcccggcctttccgtcaatggatcgccatgaaacctggcattgccttgactcctgaggtgatttacggcgctctggcttccattctaggatgaggccgaacctgaagcgggaaagtgggagtcggattgtttgacacgattcaactaacgtggtatatctttagtcagcaaatttgaatcgtatcaatagtgctgtgattcggtttgttgcacagatgttgcggttcggatactgatccaaggaggaatcatgaatctggccaaggtcgtccgaagggtcttcgccctgctagggtcctgcgtctttctgctgcctctgtccgcctgcggttccgccaatgccggtggccgtacgacgctcagcttcctatcgtggtataacgagcagaccatgaaaccgttcattgacgaattcgagcggcgtaatcctgatatttcagtggatttcagtttctcaccgcctacgcccgagtacatccagaccttgcagacgaggctggtgggcaaccaggcgcccgacgtgttcatcatcacgtcagagaacaaggccgatttgattaagaaccactatgtgcgtgacctgaccgatgagccgttcatgaaggacatagacaagaccaacaaggacttcgtcagccaaagcagcagggtttatggcatgtctctgtcctcttgggcatccggcatcgtctacaacaaggacctgctggccaaggtgggcgcaaaggatgtccctcaggattgggatggcttcctggacttgtgcgccaggctcaagaatgttggagtgactccatacttggagaccatatccgaggcaccgagccgaatcaccgacggtttccaaggctccctatacgaaagcaggggtgtggatgtcgggcatttggtcgataaaatgccccagacccccgggcaagaccaaaaagaggctaccgaggcctggcttaagctatacgagcgaggcttggtctccagaaacgttgtcggtatgagcgcggatgacatgaagagtgagttcaccaacggcagagttgccatgatttgcactggcccttgggacttcccggctttctctgagtcgggcatccattggggcctgggggctatgccggtcctgcgcaaaggcatgaccaactacgcgcagggctcgccgtctcctggttacgccatttactccggtctgtccggcgacaaactcaaggctgcgcagaagttcctgacattcttgtcgagcaaatggtccttggagcagttttcgcgtaacggcgacgcgatcaccgtcaaaggtttctcgacccaggtgattcctcagtatcgctggatatacgagcacaatgtcagaacaggcaagtatttcctcgtcacgaatttcttcgtcaagccagacgtactctccaccgaactcaaagcggagacccaacgtctgctcatgggttcggaagacgtggatggctgggccaggaacgttgatgccaagatggcggcagtgcagtgatcgctgtaaacaatctcaagagcggccgcgagaccgataagacgagcgctaggggaggaaaacgatgaaagcggatactgtcgattcccgaagtctggaatccgctgttacgggtaggtggtcttcggcggagttgccagccaagcgaaggaagcgcaagcagggattgagggaaaatgcgacatccttctggttcctgcttccgatcctggctgtgttcgtcatcttgttcgctgtacccatggtgcagacgggcatctattcgatgactgacttcaatggttacagcgtggacatgcactacgtcggctggagtaactaccgtaaagtcttctccgatccatcaaccatgcaggggttgtccttcactatcacctatgcgatagctcagaccatactggtgacttgcttcgccattcctctggcggtcacgcttaacaagaaattctgggggtgcaacttcgcccgttcggtgttcttcttcttcagcgtgccggccctggcaatcatgggtatggtctggaagtacatcttctcgcctatggatagcggcgtcatcaactcaatcctgcatggtttcggaatggggccaatcccatggttggcgaacacaggcttggctcgcgcctgcgtgattttcatctcggtatgggcgcagattggttggcatgccacactctaccttgccttcctccagtccataccagccgacatatacgagcaggccaccgtggatggagccacgccgcggcagaagttcttccatatcaccttgcctcagttggtgcccggcatcgtgacttccaccttcctgctcatgtcgggcgggctgaaggtatatgaccttccatacacattgaccaagggtggtcctggctacgccacctacacggtcacccagtcaatcatccagcagggcatcgggcaatcccaatacggcgtgggatcggccctggctgttatgttcaccctggccacggccctgttggtgttcctgcaaatggctgtcgccgaattggtttccaggaggttccaatgagtatgatgacccggtcttccaatgctggcggtcgtaatcttaccttaacgcaacgcgagcggcggcggtcggttgtgcgaagtgtagtggttctggccatcactctagtgtgcgcggtgcccttgtggtacatcatcatcaataccttcaagacaatcccggatatgtccgccaacccgctcggcctgccaaagcaatggaccttcgccaactatgtgaatgccttcgccacggtgcccatcgtgcgcagcttggttaacacagcgatcgtcactgttgtcggggtcttcttccaggtgatggtcggcgcgctggcggcctatggcatgattttgcacaagtctgtcttcaccactgtggtgggagcgatgttaatggttgctttcgtgatccccacccaatccactttgattcctctgtaccgtatggagtcctcggtagggttggtcaacacattggccggcctgatcatcatgtatctagcgggttccgtgttctgctatttcctgattgtgggctacatgcgatcactgcccttcgaagtgatcgaggcggcgcgcatcgacggcgccggtcctttccggattttccgtagtattgtccttccgctcatccggcctatcatgacgacagtcgtggttttccagactatgagtacttggaatgacttcatgacggccaacgtgttcatcagcagctcggacctgcgcacccttgtccttcaggtgtacagcgcagtggggcagttctccacggattggcccagcttcatgaccatcacggtcctggctttgatcccagtattcatcttcttcgtcctctgccagaagtggatcgtctccgggttggtggccggcgcggtgaaaggctgacgtgggcgcaggtgcaatgggcgaaaacgactaaggaaggatgagcgagccggtggcgcaggatatggagacagggcgggaacctctggtgggcacgaacccattgggcaggtactgtgccgaccctaatctggtggtgttcgacggtcggtggttcctgtactgcactgaggacgggaacgccgactggtcctccacgtccttttacgcgtacagctcgccggacctagtgcactgggatcgccggaaaatccttgacttggagcaggttccctggtggactggccagaccggtggctgggcgccgagcgtactgcgcaggggacagggtgactatctgttctatttcgtggccgaccggcagattggcgtagcgcatggcagcagtcccaatggtcctttcgtttcgatcgaccgacctatcatcgcagagggtgactatgactgctatcccatagatccagcggttttcatcgatgacgacggcagccgttacctgctctgggggaattcccgcgcttatctggcccggctggcggatgatggcatgagtgtcgaggaatcgacggctgtgagctgggtgccgggcgatttccgtgaggcgatttatatcaacaagcgtcaaggcaggtactacgcttcatggtcggaaaatgataccagggatccccggtactgtgtgcggtacgcggtctcggacagtctatttgggccatggagcgagcctaggactctgctggaaaagtgcgagagccttggcatcctggctaccggtcaccactcgatcgccaatatccccggtactgacgagtgggtgatcgcctaccatcggttcgctatgaatggccatggcgacggctgccacagggagactgtttttgcgcctctcgggttcagaagtgacggaagcatacgccaagtgaaccctcagccaggttcctactggcggcccattggccctgcctaggcgggtcgctgacctactgcttaggaggaccctgtggccggggtgatgggggctgattagcgctcgaacgcttgcttgacggccttgtactcactgtcggtgattggcaggattgagccgtggcgttttttcaagttccccaagtcgatgccgtccgtcagttcccaatcctgggggtcgcgcgaagccaggtcggcgctgcggaaggccagataacccttgccttgcgcgaattgatcgcacatgagtccgaagggcatgcgccgcccttgggggtcgtatatatcggctgcgttgtaggtgaacagctcggggccttcgaagtagtggctggaataacggccgtcgcccagaatgtccgcaaggctccctacgtaagaccaagcttggctgtcgtcggtacgctttgcctcgtatgcgcttgcgtaagggttgcgggtgcgttcgatggtgatctgcgcatctttggaaacccgataccaccaaccgtcgggtccgagcatcatgctggtgtcgatgacgtcgttcccgcggtcaatccacttggttggggtactgaaatcatgcagatccggcgaggtcgcgtaatacatgttgacgtcctggcccagttcgttggacagcgggttgccaggctcctgccgaccggccctggtggcccagtagacaatccattgtgcgcgttcatcgtcccaacttgcctcaggtgcccaggccatgccggccccggggatgggcgacgctacgtccgtcaaacgcggatcggaccaattcaccaggtccggtgaatcccagatgaccaggccggttgacccgttgacggtggccatgccctcctgccagccgcctcgatagaagatggactggtccgtggcgaggatgtggaaggcaccgtctggtcctcggacgatgaaggggtcgcgtacgcccttttctccgccgttccaggtgagcacaggatcaccctgggagcgcaaatcctcccagtggcggccgtcgcggctgagggcgaagtaaatctgctcatcggttggtgcttgctcgtcccccgtgaaatgggcgaacaggtaggcgttcgtctctgtgagctggttgatcgtcatcgtctgcggcggcctttcgcgtatctgggtttgccaaccttcactggctaggacttaccatcgctgttattatagcgggaagccacaaccttatgcctgcgcgcatggttgccgattggcgtgcgtctactccttggcgatagggtggccaccgaactgctctcgcagggcggagaccactttcatggtgatcggatcggagatcttagaaccctggcgggcgtagagggaggcggtggtgacgggcactggcacgcccagcttgagcgcgtcctggatcatccacttggcttcgcctgattcgtccgccttgccggcgatgtgctccaggcccgggtcttcctgcagggccttgaccatcaggtcaagcagccaggatttgatgaccgagccctcccgccatgaggcagccacctgatcggggttcttgactagaggcgaggcctgcatgatcgcatacccctccgccagcgcctgcatcatgccgtattcgatgccgttgtgcaccatcttggcgtagtgccccgcgccgatgcctccggcgtgcaccagtccgttctcgccttcgggtttgagggcttccaggatgggcaggatgcgctcaaagtcttcgtcggaaccgccggccatcagagcgtaacccctctctttgccccagatgccgttggaagtgcccacgtccaccaggccgattccgcgttcggacaggagcttggcgtgttccatgtcctgggtgaagtgggtgttgcctccgtcaatcaccaggtcgccgggctctaacaggtcgtacaggcagccgatggtctcttcggtgggcttgccggcgggcaccatcacccaaatcgcccttggcgcttgcagcgcgccgaccagggcctccaaggagtccacgtctcgaccggagtccgggtccaggtcgtagcccaccacctggtggcccgcgcccttaatccgttccgccatgttgaggcccatccggcctagtccaatcattccgatttgcattgtcgtcttcctttcgtgttgttcgttgatttgcgttaacggtggtcgctgtccggtctgccgtgccctttcccgttcgacttcctcggtgtgcgttgatgccgcgcacttgagccccagcgtgtcgatgacctcctctgcctcaatctgaggcgaggggttcaggttgacatcgatggttaggtgaatttcatctgttcctaggggctccagcgtgtcgaactgggacttgagcatggcgggtttcatgaagtgcccatgccgcctggatagccgatccataatcaagtcgtagtcgccgctcaggtggatgaagatgaccccaggcatgcgcagtttatcgcggtactcgcgtttgagcgctgagcaggtgacagtgccaggtcggccctggcggatgtgatcggctatccaggtgtggatgcgctccaaccagggccagcggtccgtgtcatccagaggtatgccgcgcgccatcttctcgatattggcggcggggtggaagtcgtcggcttcggccatatcccagccgagcttacggctcagctgctcgttcagcgtggttttgccgcagcctgaaacccccataatcaccaggatagggttcttgccgtccaggtatccgtttgggacagtgttctgcatggcttcagggactggtgacgatgctgtgggctgcggttcgatttggcttgtgtctgccatatggattccctttctgcaagcttaggatgggtcgctctgtgctgtatgatcccggcttcatgcagttagtggcacgaagatgctcagcagcatgaccaatgccagcaccacaacggagagcaggcactccagcacggaccaggatttgagcgtctcgcccacgcttaggctgaagtactctttgatgagccagaagccggcgtcgttcaggtgggagaggaagatggatccggcgcctatggccagcaccagcagtgtgactgcggaggggctggcgttcatcatggccatggcgttgctgaggattcccgccgtggtcaggatggagacagtggccgagccggtagcgatacgtacgaaggccgcaatcagccaaccgagcaggaagatggatacatgcgacgattccacgaagttgccgatgatctggccgatgccggtcgagaccagcacacctttgaatcctccgccgcctcccacaatcagtaggatgcctgctactgggggcaaggcagcgccgagtgagtcgttgaccgtcttccaggggatgccagatgcggctttgaggctgagcatggcaaagatgagcgagatggccagtgccataatcgggttgcctacaaaattgataacctggccgaaaccgctggtcgagctgctgaagccgggactggcaatctcaaaaatcgaggtcagcagcatgagggccgcgggcaggagaatgcagcacagagagagtccgaagggaggcagtttcgcttcctgctccacggctttatcgctgcgcgttacgaagtcagcaggagcctggaccggcacccactttgcggcgattttagaaaacagcggtccgacaatcagcagggtgactatggcgatagggatgccgaacatcatggtcagtccaatgttgccgcctgttttgaactggctcagcgccgcgagggggccggggtggggaggcacgcatgcatgcataatggacaaacccgctagggtggggatggctacgcgcataaggggcagtttggtgcgccgcgccaccaggatgatgacgggcacgagcacgaccaggccgacctcaaagaacatgggcagtccgatgagggcgccgatcagggccatgatccaggggatggaagcatccgaggctttagaaaccaaggagttgaccacttggtcagtggctccggtatccatgagcacgcgcccaatcatggcccccaggccaataaggatgcccacgctgcccatcgtcttgccgaattcgctgctgaaactggtgattgtggcgaccggtccgtagccggaaccgatgccgaccaccagtgctgctgccagcagggagatgaaggggtggagtttggtgacggtcaccagcaggatgagcacgatgaggctcaatacgaggctaactcccagtctggttgtggaaagttggggcgttccagctgccagagtcatggctgcgcccctactcgccgccgctgcaagtcggtacatgcgttcctcttctctgaggattaggctgtcggtctcggtcgggggcgagacgaactgctccgaaaagagcggaactctgccgttgtcgggccggcaagcactaatgtttacggacaatattatttctgcatacaataatgtatgccatatttattaaatgtaatactaaataatggattctggcaagtccgagtttggcctgcaccggaatggcgaaaccgggagggtcgcggaacaggacgcttgctaggctgaatgtatgaatgcagcatcagagattgttgacacgccaaggcgtaccctccatgatcggcttttgaatgaatgggggcaggcaatcgtcagtggtgctgtgaagcccggagagcacttgcctgatccggagggcggcgaaggacagccttcgcgcacggtgacgcgggaagtggtccgtgtactggagtcgatgggattagttgacgtcaggcgcaaggcgggggtgcgggtctgcgccgaggagcactggaacatattcgacccgcaagtgattgactggcggttgcaagggtcgcggcgggtccaagccctccacgagctctcccaactgagggctggcgtagagcctctggcagcccggttggcggcgggacaagagcggccggatgattgggcgcagcttacccgggcggccatcgacatgaccgcatacagccagcatgctgcgggaccgcagtacttggaagccgatgagcgctttcaccgggcgcttctgaaggcgtccggcaacgccatgtttgcagccctgggagatgtgatagcttcggtgctgcatgggcggactaagttggagctgatgccgcagcgggccgatgctgtggcactgcgtctgcacaccgatgccgcggcttatatacgcgcgggcgatgcggacgctgccgaatgggctctgcggcagatagtggacgaatcggatagcgccatagagcgttcctcgcagttgtggagagcgggcaatcagtaaggtttggagggttggttctgggcggtgacttgattactcaggcgatttcgtggcttggcgaattgagctcggcggcggcatcgtggtccagaagccacagggtctcctggcggccctcaccgtaggaagagggaacgtgtgggtcgttgcggcctgagagcgcgctcttgaccccttgcgccttctccgctgtagaggcgaagaaccagaccttgcggctgcggcggatgcagggcacggtcaggctcagacgcatggacggcggcttgggggagtggttgacccccactacgttcacggtctcgtcggtgatttcggcttcgccatggtcagggaagagcgatgcgaaatgtccatccggccccaccccgaagaccgcaaggtcgaagtggggctcgtcgcccaggtcataggccagctcgcgctcatactcgctggcgccggcgcgcagtgcttcctcattgtcctcatcgctggcgccggccacctgctcgggggcgcgccggtccactggcatctcgtgcacgttcgacttgggcagcagcccctgctcgatcagccgaccgtaccaagcccgacgcgcctgaccggcgttgcggtccacgtccccgaacggcacgaaacgctcatcgctccaccataggtgtacccgggcccagtccacggtctcgctcaaggggctgtcggacatggaggcgtagatgtcgttggcatcccggcctcctgtcagggccaggtccaccctgggctggcgggccaggcggtcgccgagttccagcagtatgcgggccgcagtggcctcgatcagcagtcgctcgcttgggtaggtgattgttatgcgttccgacacgtgctctccttacatcactacttgcatatccacgggggcggcgcgctggtccctcctggccgggctcagcggtggtccaccaagccccaacctgtgctcactacctcagcgtagacctcatccgggtccaagcggcccagctcctcacccaggcagtccacggtcgtgcgcaagggcagggagacggtctgatcagcctggcctggctgcctgatgacagcgtggtcgctcttgaagcgttccatgctcagttgtccgtcctcgcgttcgaagtagacgccggtgatggcctgggcggcggggtcgcgatccacgctgaccggtacgccaagcttcagcgccagccaggaggccagcagctccaagggcaggtagttggtctggccgctgactctcacggattggaccggcaggtgcggcggctggtccagcatcgaagccagcatggcccgccagatggtgatgcgtgtccaggagaggtcgatgtcgtccggctggcagtgttcgcgcagctgctcgaaggcggctggagggtcgcttgcgttctgggcgtcggtgatccggctggatgacttggagcccacggggtcatccgaggggttgcttggcgcctggttgggccaccaggtgacaatcggcacgtccggcaccagcaggggaatcaccagggcgtccagatgcttcagcaatccgtcgaccggggcgagcacgatgacttcgcctgcgccggcatccgcgccgaagcgaatctgtgcgtccagggtccgctcctgctggtccgcaggcggcacgcttgtgaagcagtcatggtcgggtccggggtcgggcgtccaggcggacccttcgcccttgccgtcggtcacaatcgcgatcacccggcaggggtgttcccggctggccgcgttcaccgcctccaaggcctgctccaggtcagcctggcaggtggagatgatcagtgtgagcacgcggtccatgcccgcctcgccacgctccacatgcatctcatcaatctcgtgggcgatggccgctgtggtggtgttcggcattgctacaatcatggcatcctccaatggtgtccgtcggcggccagcatgcggtccgcctgggctggcccccaggtgcccgcgcggtaaggttcaggttggcccagccccgcccagtactcttcgattggatccaggattttccaggacaggtccacttcaccgctggtggggaagaggggagggtcgcctaggagcacatccaggatcaggcgctcgtaggcctcgggcgaggcttcggtgaaggaacgcccataggagaagtccatgttcacatcgcgcacttccatggccgagcctggcgtcttggcgccgaatcgtaaggtcacgccttcatcgggctgcacgcgaatcactacggcgttagcgcccagctcgcgggtggctgtggcgtcgaaaggcaggtggggggcgcgtttaaagaccacggcgatctcggagacgcgcttgcccaggcgtttgccggtgcgcaggtagaagggcacgcccgcccaacggcgggtgtccacatccaggcggatggctgcataagtctcggtcgtggacttggggtcgatgccctgctcctccaggtagcccaccaccggctgcgaaccctgccagccggcggagtactggccacgggcggtgtgcgcgcccaggtccttgggcaggcggacggcggagagcaccttggtcttctcagcagtcaggtcggacgcggcgaaggagaccggctcctccatggcggtcagggccatcagctggagcaggtggttctgaatcacgtcgcgggccgccccaattccgtcgtagtagccggcgcggccgccgatacccatgtcttccgccatggtgatttgcacgtgcgagacgtagttggcgttccagaccggctcgaacatcatgttggcgaagcgtagggccaggatgttctgcacggtctccttacccaggtagtggtcgatgcggaagaccgaatccggttcgaacacctcgccgaccacccggtccagctccttggcggaggccaggtcgtggccaaagggcttctctatgatgacccgcttccaggcgcccgggtctgagtgcgccagaccggatgacgccagctgctcggacaccaccgggaaggccttgggcgggatggacatgtagaaggcgtgattgccgcgcgtgccccggtcccggtccagttcggagacggtctgggagagtttgcggaaggcttcggcatcgtcgaagttgcctttgacgaaacgcatgccttccttcaagtgcctccaggtggcctcgttgaagggggtgcgtgagtgggcgcgcacattctcctcggcgaaggcggcgaactcatcggtcgtccagtcgcgtcggccgaagccaatcaggccaaaggatgcgggcagcaggccgcggttggccaggtcgtagacggccggaagcagcttcttcttcgacaaatcgccggtcacgccgaagatgaccagagagcttgggccggcaatgcgcggcatgcgaaggtcgcgtgcgtccatcagcgggttttcccaaggcttgtgcccgcctggctcggtttcaccggatgcggcttgtgaacttgccatgcacctcacactcctcaaataggtgtcacttccaaattctagggcagtaacagtccatcacgcgctgggcaaaccctgacgggatcatcatgtactacacggatgatcagaacagtccatcacgcgctgggcaaaccccaacgagcgatttcttgtgtgttcccacccacattcgaacgcatcgccttggcggaatgtccctgcatgcacggctcgcacggcctgaccatcaatggttggataccggtcaacccgtccgccgaagagggcgtatatgacatggccggagcggcgagtgcggttccgtggtccggtgccgtacatctttgctctgagtcacgacgaggtgagtcgcggggaggacaagggcggcggcccgaagcctgaccttgtaccaatcggtgtgggacaacgcctatgccttgcccgagatggacgagaggttcccgccaaagccggggcttgacgattcgcatggttgcgatgaggcgcgagtttgggctgtgagaccagtggttcgtgcgacttggtgctgcgaggtggccggcttgcgcgccttcgcggtatggctgtgggtggttgaatgcggcgcctcaatccattttgaaacgcgcaagggctgactgccgccaaccggcgcggcacctgcgtcgagctgacggcttccgattcggacagccgcgctgaaggcgtcccgcccgaccgctggtcggatggtgcgtccctagccgggctcactgttcgacgcggcagccgcacgtgttggagattgtggcgttcagggagtagctggtggaggtgcgggccatcaggtcgtcgatggaggccaggagggcgaagacgacctggggctcgccgcgcactattgtggccatgtcgttggtctcgtaagccaggccggaggtcttgatgagctccaggacttggcccaccgggctagtgtagtcggcctgggccagtgggtacaggctcagttgacagctgatgcgacgaagcgaacgcatgtgaaacctcctggggtggctgggtttgtatgggatgccctgtcctgacggcgggattcctcggccagggtgtatgcggcgtcgggcagggacggggggatgaagaggcagtcgcgacgaccggtgaaatgggacgggtccagggagatcagctggtcggcggtcaggaagcgcgcatattcgtaagcggtgccctggcagaccgggctctcatagaggttggcccagggggcgccgtgctggatggtgccgatgacgatgctgccgccgggcttgaccaggcggcgcatggcccggtaggccgctgccggattgggcaggaactcgaagcaggccatcgagaaggctgagtcgaaggaaccggcggaccagtcgggcagtggtgtgtgctccgcggaagcgtcgtataggtcggacggggtgtccggcgcgctgttcgctggcgcggcagtttcgttttcggggctggccaggcgggttatgtctagcagccgcaggtcggcggactgcttgcgctcagccagtttgcggcgggcttggtcgagcatgttcagagcgatgtcgactccgctcaccttgcaaccggcctgggccagcttgccggtgaagttgccggtgccgcatcccacctccaggatggactggccggtcttgggctccaacagttccagcagggcgcgggtctgcacctggtccgccagcgccccgggcgcggtatccagccactcgtcgtaatccgcgtaaaagtggttaaacacgttaatcatgcgcgctccttccgccctcggcggcctgtcccttcaagcctatgccccgcccttgtcagcagggcggcgcgggttcgggtgcgggttgggggagaacactagagtggggggcatgattccttctgttgagtgggccgaggagctgcaccgtagggtagcgccctcgccggcggcttatgagctgatccatacgcattgcgtgattatcgccgggattgggaaagagctggcccagcgcgccaacgcacggtaccgggcagcgcaggtgcgcgcggcgtccaacgcttcgatggactccgccgtgccccagcgggagctcgacgcggacctggtctacctgggtgggctcttgcacgacatcggtgcctaccgaatcctcgcctcggacggggctgacggccgaccgctggccttcgatgaccgctacatccagcacggcatcgcaggctacgagctcctgaaagccgaaggcgtggacgagtcgatcgcgcagttcgcgcgcaaccatacgggagtagggctcacgcgtcagcaagtggaggccgagcacctgaacctgccggtggacgactacgtgccccagagcctggagcaggagctggtcatgtacgcggacaactaccactccaagcatcagccgcccatcttcgtttccgaaccgacggccgctaagcgcacagcccgctacggcgaggagaacctgtgccgatggaagaccctggtcgccaagtacggggtgcccgccttggagcctctggcccgcgaataccggatggacatcgtctaatccgagcgcgcgccgatggtagggggggcgggtccaagccaagtggctcggaccaaggcgaatcagctgggtcaaagccgctagtcggtgtggttggctgcatggctttggcggtcagcgccaccttatcgattgagtttttgccgtgatgaggcgcctgggtggaaggcggcgtagcggcggctgaaggagcgccgcatccaggggtccggggcgtaggggggttcgcgcggatcggcctggctggattgcagggcgtccaagtaagccgccataccctgggggccgtaggcgtagggggcggcgcaccacagtgggttggcctccaagatgattggcgggccggactgggtgaaggccaggtcgatcgcgcccgaggtcaagcccccggcgctcgccgccgcctgggctgcttggagcgcagcggcccggcgggcggggtcgaagtgggcgccgtcgaagaccgagacgatgcgccgtccgcctgcggggtcgtgcaggcagtagcccgaagccgctattgggcgaccagcgtccaagagcacccgccactcctcgctgatgtctggtatgtggctactcagctgaatcagggagtccggcggcgccgtggccaggctggcttggagttcaggcaggctgcgctgggcggcgcggaaggccaagacccgaccttgggccagctgcgaccaggggcgatcgcctaggccagagggcaggctccgccagcccagtatccgcttggcgggcgcggccactatccgccggcccgcgagttcgggggcgacttgggccagctcggccagccaggtggctcggggggagggcaggcgcaggggctcgctcccccaggcggtcagccaagcgttactggcgatgagcagggctggggctatccagagcgcgtcggcttggctgaggccgtccggcggtgccagtccgttttgcgcccgcagtgaccaggcggctccacctgcctgatccagggtttgggaaataatttcggaaatccaattttcatttgctactacttggcagacttttgccttattcggtggaaattcagtggtcatatcgcttaacattcttcaccttattaccaatcgtccctgggcctggcgccgggggagaatccgctcccctgagggctcaagggggcagacagccggccctaggctagctatgctgtagacaacacgccccacatgcgtggaccccaggcatgaagggtgggcgcaggccatagccgcttcaggcggcttcccaagcttaaaaggagaaagcccatgaccaccatagccgtattcgtcggatcgctgcgcaaggaatccctgaacaagaagctggcccgcgccatcgagcgcctgctgcccgaaggcgtgaatttcgagtacgctgaccttgacctgcccctgttcaaccaggatgaggagaatgacatgcccgccaaggtgctggagctcaagcgcctggtcgagcggtcagatggcgtgctcttcgtcacccccgagtacaaccgcagcattcctggcgtcttgaagaacgcgatcgactgggcctccaggccgtggagccagagctcgttcgccggcaagcccacagccatcgtgggtgccagctccggagccctgggcgccacccaagcccaggccgcccttcgcaatgtcctcctctacctggacatgaaggtgatgggccagccggaggtctactttaatggatcgacaggcttcgggcccgacggcgaactggtggaagggtcggaggacttcatccgtggcttcgcccaggccttcgctgaccatgtgaaggccaatagctgagccggataggctgggcgcgcggtcgttcgcgcggtaagtgagagggcgggcgcctggtccaaggacctgggcgcccgccctcggtgcgatgcgtcggtcggttcgcgcgcggccggcgcttctgcgcgcttctgcctattccagtgtgtaggtacggtcatagggaccctcggaggggtgacccgagcaggctacgatcaccgcgcaatcatggcggcgggccgtctttctgagcagggcgaggatatcggcagcctcgtcttcgctcaggccgtccatcagctcctgggtcaagagcacgtctggctcgcaggagatggcccgggccagggcggcccgcacataatccaggcggctgagctcgcgcaccggacgctgctccaggcgctcggggaagctcatctcctccagcaggtcgcgggcctgcgtgtccttgggtttcaggaaggttcggccggaggcttccatggcgtacgacaagttctcaaccgcgctcatatcggtgcgcagggcgtcgcgggcgaagatgacgcccagctggtggccccggtagtcccaggcctcaatctgacgcaggtcggtgccgcggaagagcaccgtgccctcgctgggggccagcagacccgagattacgcccatcagggcgcccaggcgctcggggcttccggtctgaacgcagtgggtgcggcgtatgcggaaggacatatccacgtcgtccagcaggtaggtggtcgagtccttgcccctgccgctcaggctgacgtgccgcagctccaggacggggtagccggagggcaccgggatgtcggtgtcatccatgtccgtgtccatgctggcaagcgggtcctcatcgtccgaggaccaatccccctcctcaacggcttcgctttcgatgacgaccttgaactccggctcggagccgtcttcctgcccgtcgtcagcctcttgggaagcctcatcgcctatggccgcgaaatcctctatgggttgagcgggctctgtccgccgcgtgtcctcggcgcgacgggcggtgccctcctgaggtgcctccggcttttcctggcctacggtctgggcgtcctggccctcatccggtttctcgctgctggtcatgccgtctcctttgcgtctgctgcatcggtctggggcgcgcctggggcctggcttacggcgatcggctggtagaggcgcgaagtgcggaaggtccctgcgtatacccacgcgagcagggcgataatgaagcagatggccaggccgctgccgcacacccgccagagggcggcagcgggcatctgctggatgccgggcagggtgattgctgagcgcaccgccgctgggcacaaagccgtgccggcgcccaagcctatcagcaggccaggcagggtgacgatcagggtctccaaggccatttgccagcctattcgcgccttggatacgccgattgtgatggctacgcccagttcgttggcccggaacatgagcccgaagatcagccagaccagggcgaggacggctccgaagaccaggatggcgatcaggagggcgcgaatcttgccggaccggtcgtgcaggggctggacgctgcgctggtaggcctccaggctgggcgaggacacatcgtactgcttggccgacaaaccggccttatgcagggtgtcggtgaaccgcttgagggcgtccgggttttgcagcctgaagcccacaacgagatcgcggcccttgtctcctggctggccggccttgtcgaagccgtgctgggcgaaggtcgcgtaagcggcgtacaccgcgttcgccgccgggcccttggcctgagcgccggtgacctcgtagatgcccgatacgctcatgtccacggtcttgcccgcgttcgcggggtccgctatcttaatgacggaccctgtcttaagccggttggcctctgccaagggctgcgagaccaggacggcatcgcccgcggactcggagtagtccagatccttgccctgcacccggttgatcttgccataagggcccttggccgcgaccgtggagtccgacagtccgaccaggttcatctccccctggccgccgaccggcttaatcccctggaaactggcgggcgcggtctcgtagtagtaagcgccgaactggatgctgttggcctggaggagctgggcgtattgggaatactgctcccaggtcaggggtttggccgtcttccccttgccttggccatccgtcttaggcgtgattacggcatccgtggcttgggtgtcataaatcgtggtacgggtgtcctcgtccgcctggagcacggtcaggccgaccaccgctgaggcggtcaccgcaatgcagacgatgaggaacgtggcattgcgcgccttgttccgtgtgattgctctccatgcgttcttcaggacgaacatggcatccttcccacttgtctggccgccccccgggccgccgagtcggacggttcgggggtttcgaggcggctggtggcctcggttccacgaacttcagtctatccgcccaggctcccaaatctgttggacagcctatggctcctgactgagcttttcctgggagcgggctgggagcctggggagggcggccaggtggcagtatgacagggctttcaggcctgcgcggcccccttggcttcgtcgtcgctgtcggtgccagcgtgggagaagcgcttgacgcgaagcgagatgagcagggccagcgcgatgagcgccaggatgaaccagatgcccaggtgcatgccgttcgcgaacgcctgaggggcggaggcgccagccgagtgggattcgccgatggccagcaggctggtggccagggcggttgagaccgcgcccacgatctgctgcatggtgttcatgatcgtggagccgtcgccggactgggccggcttgagtgagttgagcgcgtaggtttgggccggcgacatggcaagcgggcagccgaccatcaggacgacgtgggccgcgaccacgtatgcgaccggggtgctggggctggtgaacaggaacatgaccgcgcccaccagggccaggatgaagccgcaacggaccgggagcttggccccgaagccgtcgtagagacggcccgccaggcccgagaccagggcgttgacagcgcctccgggcagcatgagcacgccggtcagggccaccgggagcagcaggccccgctggaggtattgaggaagcatgtacatggcggccaggatgatcgcgaagtccagcatgaccagggccgcgccggcccggaaggccggtatcgagaagatgcgcaggttcaggaccggctgcttcaggcccagctggcggcgggcatagaggatgagcgccacgatggcgaccaggaggatgatcaaggtgaccggggagagccagccgtatttagcggccaggctgacgcccgccaccaggccgccgaagcctatgatcgatcccaagatggagggcaggtcgatgcgggggcgggtgatggttcccacgttgcgcaggaaaccaacggcgaagaagatcgccaggacaaggaaagggatgaagaaccagaagacccagcgccagctgagcttgcccaggatcaggccggtcagggtggggcctatggccggggcgaacatgatgaccagggcgcacatgcccatcaccgcgcccagcctggcgggcgggaagatcagcatggccacggtgaacatgaggggcaaaatcagcccggtgccgatgccctggatcaggcgaccgaccaggagcaccccgaaggacggggccagggccgagatggccgagcccgcgatgaaggccagcagaccgaagatcacggtttggcgggtggtgaaccacttggagatgaagctggagaagggcaggacgatgccgatgaccagcatgtagccggtgaccagccactgggcggtggcggccgggatttggaaagcatccatcaggttgggcagggcgatgttgagcgaagtctcgctcaacatgccaacgaaagcgccgatcattagggccgcgatcgccagccaggggtgggctaggcgcaccggggagggtgcgggtttgggcctggggcctgacgcggccgccccggtcggggtcttggaaggttctgcggtttgggccgcgttggaggcaggcagggctgtctgttgattcacgatgattctcctcttgtctgtagagacaagttgccatgctagggagaattctcgtttttcgtaagccgacgtggctatgtgagatcggtcacatgccttggagcccacctgttctggcgcctggtacgggctgcgccgccagccaaggcacacaagcgggccggggcacccactggggatgactccggcccgccagcttctcgcccggctgctaaagccgggaccataccttactcactgggcgatgaagccgccgtccaccacgaactcgctacccatggcgaacttggactcgtccgagcccaagtagacgcaaatctcgccgatatcatcggggtcgccgatatgccccaagggggtcagctcggccatcgccttttccagatgatcgttgagcaatggggtcttgatgaacccggggtggaccgagttgacacgcacattgtagccgttggccgccgaatccagcgccgccgccttggtcagggagcgggagccgcccttactggcgttgtaaggtccgccgaagcgcatgcccacgaagccctcgatcgaagagatgttgatgatcgagccgcccttgcccttcatggtcgccatgccatgcttgacacccaggaaggtgccgtccaggttgactctgatgaccttcttccagtcgtcatagggctcctggtcaatcgggacggctttgggggcgatgcctgcgttgttgaccacgatgtccaggctgccgtaagccttgatggtcttgtcgatcacatcctgccactgagcctcgtcggttacgtcaagcgccatgaagcgagcctggtccccgcgctcgtcgaggaaatgcttggactcttcggtctccttgatgtctgtcagaacaaccttggcgccttcgcgcacgtagcactcggcgatgcccaatccgatgccaccggtcccgccggtgatgatcgcgactttgcctttgagtctatctgtcattttgacctccttgtctcgatgcgcatgttcgcagtgcatgcgttttcaacctactccaggcaagagggggttggcaagtccgcagggatgaggcgggagaacgcggtagacggggaggcgccggcgtgagcaagcgcggcatgccgggctgccctgagtcctctgggccgcgtgatcgtggggcggcggtttgaggtcagtcgctcgacttggagcgttcgaccggccggggtcgggggtgggccagccgggcgaacagggcgactgtgcccaagcccgcagccgccatcagcgtcagccccgccacccggtggattggcgtggcgccggctgccggcaggggcgtatgtatgccccaatcgccatacaccagggtgggtgcgtctaccgcgtgggtgacgtcgaaaacgctggaatcggcgctgttgcgccagttgatgaagatgtaatcctcgcaggcgccgtttacgcagtcgctgtctcttttgggagtcttatagattttatccgcgtcggtggtgtcggcgacgctggcgccgcgatttacgctgacctgcttgctgttgctgcgggtaccgtcactccaggtgcaggcaacgctcgggtcctgcgcgcattggaaggtgacggtggacgactgcaggcgcacctgatactcgccttcgtaaatcaggttcccgttcgtatccaccaggtcccagcggaagatgaactgtttggcgccgttggggatgatgaaccggtgcgttttcgtgttgaattccacctcggtcccgtttcgcgcgggttcgccgcccgacatcgtgaactcccgggaattgctgatggtgaagcggttgtgagcggggctcgccggaggattggtttggtagaggtattgataggacgacagttggctgaagctatcgacggtcttgaacaaatcctcgatggcgatggtttgtctgccgtcgaccagcgtaatgggcacatctttctgcggcgtctgccagggaaccgcggaatccgcattatcgccggaatcatcgccggggtgcggtggcccgtggctgatagtaaaggcggacggtggcagtttgagatccgtgatcatgttccaacggaaagccccggccccgattctgacctgggcatctggcagctcgtgcaaatccaatgcggttaaagaattggccgagaaagcggattctccgattgcttgcagtctgctgggggactcaaagtccagctgcttcatatggcagccgccgaaggcctcgtagccgatcgtttggacggagctggggatggtgatcgcgccgacgctggtgtagagaaaagccttatctgcgatggacgtcaccgtatcggggatgatgattctggacagctcggtgccgttcccgctgttctccggttggtattgcatcgctccatcgccgatgctggtgacggtgtaggtggtgtcattctgggtaatctggctcggaatcttcacgcagtctccatcgtggaaccatgtccgggttgcagccattctggcggtccgagcagaggggtcagccgaccagaaccagtcgctctgggtccccaccgtcaccgtgcaggtgctgttcctcgtctgcacgcggggtgggtttgactgtccggaggggctgggcccgcggttcccggaagagccggccggcgcgccgtttgtggggaagccgtccgcgttttcggcagagctgcgaagttggcccaagccaagggcgaccatgacggcgatcatggttatgaggacggccgccgccacgcctaggcgcgcaaggtgggaggattgacggaggacagcccgtccacttttgcctctcctgaatttcatgcaactcccccatgccggccgattacccaatcggccgatatcaagcttcaacatccgccgtcgcgggcggacaccatccctgaggtgcacgccctacgctcccccctaactaatagtatccactgggcagggttacgctatgaagggatgccgttccttgcgcaaacctgacatttaccaaccgcacccccagcgggcggatgcgccgaatcggcagaaggggccgccgtgggcgtgggaggcgaaccccgcctgactccggcggcgcatgaactcggacatggcggctcggcgctcctccaggcgctcgcggctaccggggaaccgctcctgccaagagtccaaaatcagccccagggcccggtcgaacgccgccagctcctcggggctcaggccgtccagaatcccggcgcgattgcgttcgttggggcgcatccgcccggcctcccgccgcccggcctcggtcagcctgaccaccatgcgccgacggtcgttcggattgggctcgcgggtgatgaaaccggaacgttccagcttggataggagttcgcccagggcctgacggctcatgcccagcatgtaggccaggtcgcgctgctcaatctcgggcttgagggccaggatggtcaggacgcgaccctgcccgcgaagggggttgggccaggggccgtggccccagccggccagccggccctcccggctgtcaccgtcgcccgctgggcctggattgggggcggccccgtctggccccggaccgtggccgtggccggcatgggggctcggctcgggtccatgcgcaggctcgaggccccaaggcctgtgcatgagccacaggagttcgcccaggcgttccacggcctcctctttcatccgctcgccctgctggtcctgggctgcttcgccgccctcgtgcggcaggttctggtcatccattgtgcgggtgtcgctcatcatgaactcctttgggtgtgctgtatttgttggttgctgcgatgttgtggcggtcgcccaccggggctggtctcggctgcggggcgaaggcctggccggctttgggcggcggaagcggatgacaaggggcgtccgaagtttgtaaagtaccttacggatttgattctagggcttccgcgacggttgtgtcaagtaccttacatatgcaggtggaggacggtcatccccgccctcgaacgggaatcggtcttcgctttcagccaggaggaccccttggtgagcgtggcgcggggaaaggaggtaagctcaaagtttgcggacaaacgaaaggcggagcatttggattggcatgcgtcggtgtacggggccagggccgggcgagagagccggtatgggttcgacgaggatgacgagggcttcggcttcgacggtggcgacgcggaaggcaaggcctacggccgcctggacgtggtgtcggaggcggagctcaagcgcctgggtcgcggctccttcttccgagcctacgaagttgtccaatccaagcgcttgcaaggcatggcctgccgggcccacgccagggagctggccctgtcggcttcggtggtcaactcctacgagtacgcggacgactaccaggtcaaggcacgggtggacctggacaaggccacggtcgttgactcctcctgcacctgcccggccttcgggcgcctgggggccgtctgcaagcacgtgatcgcgctggtcatgctctacaacgactcacctgagctcttcgagcagaccggccaagcccagcggccggttcagcgccgcacgtcccggcgcctgctcgacttcatggatcaagctagtgaggaacagcgccagcgcaagcgcaagcggcaggtggagctgctcaaggtcgtgggggccgagagcgaggcggaccaggcccattcgggcggcggtctcggttccgtccacctgccgatcggcagcgtaagcctgcgcccctccctctcctgcgaaggcggtgactgggggctgcgtctgcgggtcaccgtcccctcccgccacatctcctacctggccaaagacgtcgatgagctcctccaggcggtggaccactccctctactactgctacgggcgcaaactggggttcgttcactcccgcgacagcttcgatcaggcctccaagggcctgctcgacatcctccagcggggcgtccagattcgctccagcggacaggagggcgtgattgggtactaccggcagcacaaggggcccttgaccgaaatgaccctgtccgaagaagaggtctgcgacatcctcgacctctacgtcggcagtgattcgaccctggactacgcgccaggcggcaggcccaacgcccaagcacgcccggcccaggtcgtggacggggacccggacctcggcctgagcgtggagcccgccggcgagggcggcgatcgcgccggccaagggtacctgatccgccgcaagctgacggtcgaccgattcatcggcggccaccactcttcctttgtggtggcttggcccgtggggggcgaccccctcttcgagaccaacccgaccatctaccgttgctcccatgccttcgcggcccacagcgagctggtcagcgccctgtgcgcccctggctccgacagcgacgagggcaacggtcaaggtcaggggctcttcctggattccagcgacttggagaccttcagccgcaccgtcctgcccgcgctgagccctgcggctcccgcctcccaggaggccgagggcgacggcgggggcagcgcctccgataccgtcgttcccgcggcccaagacggggcttccggcacggggaagggagccatccgcgcaaccctgccccccgagctcctggacctgcgccgcctgccgtgcgtgatcgagatctacctggaccgtgacgccgacggcgtgacctgcgaccttcaagcccgctacggtgagagccgcttccatgtcttcgctgggatcggcgcccacgagccggtcgtgcgcgataagtcggccgaacgcctggccgtggaggccgcccgccactacttccccgagccccagggcgtcctcgcccgcatccccgagtcggacgataaggctatttacaagctgctgaccgaggggttgcccgtcttgcgcagcctgggcgaggtctactccacaccggccttcgacgggctgagcgccgactcccaccccacgatccggctgggcctgtcggtcaaatcaggcctagtggagatttcgccgatcgccgacgagatcgctccggaggaagtgccggccctgctggagagctaccggaggaagcagcgttaccaccggctcaagaacggagcgttcgtgaacttggcccaggccgatatgtccgcattggacgaggccgaggccgacctggggctcaagccgggctccttggaggccgggccggtaacggtgcccgcctacgaggcctactattgggacgcccaggtggaggaggaccacaaggatgaggagttcaagcgctacattcgcgacttgaagcaggtggacccctcccgttaccggttgcccgccgagctcaaaggggtcctgcggccctaccaggaggagggattccgctggctgagctcagcctgcgacaagggcttcggcggcatcctggccgatgaaatgggcctgggtaagaccgtgcaactcctggccttcctggcctctcgccagcaggaggctcgccgggtagggcccagcctgattgtgtgcccggcctcgttggtctacaactgggctgctgagtgcgccaaattcgtcccctccttgaaggtggcgccggtggccggcggcaaggaggggcgtcggcgggtgctggcccaggccggcgactgcgacctgctgatcacctcctacgatctgctgcggcgggacatcgaggactataagggcctgaagctctactgcgtggccttggacgaggcccagtacatcaagaatcacgccaccaagtccgctcaggccgtgcgcaagttggacgcccgccagcgcttcgccctgaccggcaccccaatcgagaatcgcttggccgagctctggtccatcttcgacttcctgatgcccggcatcctgggctcctaccggcgcttccgcgagcgcttcgaactgccgatcctgagcggcgacgagaacgcccaggccaaactccaggccttcgtggggcccttcatcctgcgccggcgcaaggcggacgtgttgaaggatctgcctgacaagatcgagaacgtgatcaccgtgcagcttcagggcgagcagcgcaggatttacgccgccctggagcaggggctgaggatgacgctgaacaagcagcgcgacgtggagttcaagaacggcaagctccaggtcctggcccaactgacccgcctgcgccaggtctgctgcgacccccgcctgctctactccaacgtgggcgagggtgtgcccgaggcggcttcggcgatcgctcgggaggccgcgagcccccaggctttcggcaagccggccgaggtggagcagatggcctccgagcgcctggagcaggcggcggagcaagcccggcgcgccccccgcaagattccctcggccaagttggacgcgatcgaggagctggtggggtcctgccgggacgcgggccgcaagatgctgatcttctcccagttcacctcctacctggatctgatcgccgagcgcctgcgcgccgacggggtggactacaaggtcatcacaggcgccacccccaagcgcaagcgtctggagttggtggactcctttaatgaagacgacaccccggtcttcctgatatcccttaaggccggcaacaccgggctcaacctgaccggcgcatgcgtggtggtgcatgcggacccttggtggaacgccgccgcccaggagcaggccaatgaccgcgcccaccggatcgggcagacccaggacgtcaacgtttaccagatcgtggccaaggacacgatcgaggagcggattctgggcctgcagaagagcaagtccgatctggcctcgcgtttcgtggactccacttcatccaccaacgggacctcgatctcctcgctgacccgggacgacctgctctcgctcctgggttgacggtctgtgattacgccgctgtcggggccgggcaagggcgcctgagctccgatgtggtaataatttattattgtgataaacttttattgaatcgcgtcctgaccgggcgctcgccctcatgccttcaatggagaaaggatgttcctcgtgaagaagctaccagaagcgataggcccctactcaagttaccggacgcaaggacggttcctgatcacctcagggcagctgccgctcaatccggagaccaaccgaatcgaagccacgagcgtccacgaccaggctttgcagagcctggcgaacatcggcgccatcctctcgaacgagggtctggagtggtcggatgtgatcaaactcaccgttttcatggacgacctgtccgtcttctccgaggtcaatgaggcgttctcgcaggcgcttaaggagcccttcccggctaggacggcgattgaggtctccgccctgcccatgcagtcccatattgaaatcgaagcgatcgccctagggggtcaaggatgagcggaagcattacggaccaagcgaacggggtcaaactcagctcggtcgagaaacatgcggccaaggccggcatgaccgtggatgaatggaaaaaggccactaagttcgacggcaccgactggggctgggtcgttatgagcatcggcatggccatcggcgccggcatcgtcttcctgccggtcaaggtgggcatgatcggtttgtgggtcttcctggtctcggcggtcatcgcctatccggccatgtaccttttccagaagctcttcatcaacacgttggctgaatcggacgagtgcgaggattacccctcggtcatcagcggctacctgggcaagaattggggattcttcctgggcgtgctctacttcctgatgctgctgatctgggtcttcgtctactcgacggccatcacgaacgattcggcctcctacctgcactccttccacatcaccaagggcgtctggtcggacaaccccttctacgggctggtgatcgtcatcgccctggtgtccatcgcctcccgggctgagaaggtgctcttccgcatctcaaccttcatggtgctgaccaagctggtcatcgtcgccgccctgggcgtggtcatgatcgggatgtggaacttgaagaacgtcggcgctttcccccctatgggctacctggtcaagcagaccatcgtcctgctgccgttcacgctgacctccatcctgttcatccagtcgctctccccgatggtcatctccttccgctctcacaacaagagcgtcgaagtggctcgatacaaggcgctgagggccatgaacatcgccttcgtcaccctcttcgtcgtggtcttcttctacgcggtctccttcaacctggccttgggccatgaccaggcggtcgaagcttacgagaagaacgtctccacgctggccatcgcggcgcagaacatgcctggcaactatgtgaagatcctgagcttgatcctcaacatcttcgcggtcatgaccgctttcttcggggtcttcatgggtttcaaggaagcctgccaaggcatcgccaccaacgtcctcaagcgtttcattcccgaagacaagatcaatatgaaggtcctgagcttctcgattctcgtcttttcggtcctggtcgcctggggcgctatcctgctgaacgctcccgtaacgagcttcacatccatctgctcgccgatcttcggcatgataggctgcctgattcccgtctatctggtctacaaggtccccaagctccacaagttcaagggccccagcctctacttgattatcttcgtaggcatcttgctggtggtttcgcccttcttcgcattcctgtaatgcgccaagcagcgcttcagcgctaaccaatcggaaggaaatatcatgatgcagaccaatgaggatctgttcatccaagcgctcagggagaacgtgctgcctgccaccggctgcaccgagcccgtagccgtcgcttacgccgcggccaacgccatcaaattgatggacgacaagaccgtggggcatgtgcgcgtctcggtctcgcccaatatcctgaagaacgccctggccgtgatcgtgcccggcaccggcgcccccggcctgaagatcgcgtccgccgccggcatcatctccggccagcccgacgccgggctcaaggtgatcgccgacatcgaccccgaggatgtcggcaagatcaaggccttggccgactccggcaagatcgatgtgaacgcggcccacgtcgatgacgacctgtacgtggaggtggagatcgccaacgactccgaggacgtgaccgtttacatcgccggcgaccacaccaacatctacaagatcgcgcgcaatggccaggtcctcaaggaggaggagcgcccggcggcccacgcggtctcctcggtccggcaggcgctgcaaagccataagctacgcgagatgtgggatttcgcactgaatgagcccttggaggagatcgccttcatggacgaggccggcaagctgaacatggcgctggccgaggaagggcttacacacgagtacgggctcaagctaggcatgtcgatgaacaaggcgcgctccgtgaactttggctccggcgtggacgctgacatctccaccgagatcgtcgcgtacgcttccgccgcctccgacgctcgcatgggtggcgctacgctgccggccatgtcgaactcaggctcgggcaaccagggaatctcggccaccgtgccggtgtgcgtggtcgccaagtacgtgggcgcctcggacgagcagcgtatccgcgccctggccatgtcccacctcatcgccatctacatccactccttcctgccgatcctcggccccttctgcgccaccgactccgcgtcgatgggcgctgcggccgccgtcgtctacctgatgggcgaggattacgacaccgccgcagcggccatcaacaacatggccggcgacgccgcgggcatggtctgcgatggcgctggttgctcctgcgcgatgaaggtcgccacctcggcatcatccatgtaccgctcggtcaacctggccctccagggcgtcgagatcccctccagcaacggcatggtctgccccgacgtggaccagaccatccgcggcatcggccgcttgggcaccgagggcatggagtccaccgatccggtcgtgattgatgtgatgatgaacaagggctgatcccgccgcttggcaagcagggcggtcgtccgggctacaggctcggacgaccgccctgcggcgttcgactaagcgctgggctggccggctttgcaggcggtagactgaactctcgaggtgattatggaagatacgatcgagccccccgacggggcggagcgcgggcaggcgcaggtcctggaggacaggcgtttcgtcatgaccttcaaacccttggtcgaattcttgggtaaggtctatgggcctatgactgaggtggccctgcacgacgcctcccaacccaacagctccatagtggccattgccaatgggcacgtcagcggcaggggcttgggcgctccggccaccgacctgatgctgcggatcctgggccggggcgaggcggaaaaccgcgactacttggtcggttacgcggggcactcggccaacagcgcgacgccgctggtctcctccaccttcttcatccgccgccaggggcgaatcgtcggcatgctttgcatcaaccacgaccagaccgccctctccaggctctcccaggctgtcggagaagtgcgccaggcctacttcccgctctctacggagatgccaccggcggcggacgcctcaaccgtggaggccccatcttcctcggtcccaccggccgtggcctccgaattcccgtcctccccttcccggatcaaccacgcgtcggcggtcgggagcgccgccgaggaggagaacctgagtttgtcggtggaggacatggcccagcgggtggtcaacgaggcggtctcttcgaccggccgtgaactcagccgcttcagccttgatgagcgcatgggtgtgatccgcgagctcgatgcctcaggctatttcctgctcaaaggctcaatctccagcatcgccggactgcttgacgtagccgaatccacgatttaccgctacctccaacagtcccgcaagcgctgagggtcgactggcggaccttcaccaggccgcagaccggggtcagttcgtcgttgcagcgtcgcggatgcggccgattttcagggcggtttgcaagacgaaggcctctcgggggttggtggggtcccagccggtgattttgaccgactgcttgagacggtagcgcactgtgttggggtggacgctcaggcgcttggcggcggattccagcgagcgtccgcaagacaggaaagcatccagggtggccagcatgatctggtggggatcgctttggcgtagacgcccgtacacatcccggtagagctggtccgcagccgcggcatcgcctaccaagacccgctccggcaggacatcgtcggcttggaggggtcgggccgggccgccccctgcgaacacgtcatcggccgctggagccacctggtaggtcgtgagcgcggcgcggatggtctctgaggcgccctcaacgccccggcgcaggggccctaggcagaccggcgcgtcctcggcgaagaagtggagcaggccggcgctcacttcctcaggcccgccctggtcgcgcgggtcaatcaggacgaccgtcagatcgttgtgggccgagaccaggcacaggcccccgatggaccgcactctgcgacggatgcggctggccgccgcactggagcttaactgcccgcccttcctgggcttgccgaccagggcgaagcaggagctctcgcccggccagcccaggaccgccatctgcgaggccactttgctgtcggtcactccgttagccaggttctccatcgcgtacgtctcggcgcgcacgttccagctttcgcgcatctcggccgtgtcagcgtagatggcggcggcggagaaggccacttcgcgcgcatagtagagaatcgcgtcgcgggtggctcgttcctggcccttctgggcgaacgcttccacgttgttctccagcaggtccacgatcactcgtgtcacatccaaggcctggcgcaggctgaccacctgggtgaactccaggggcgcgatgaagaagatgtgctccagcgaagggcggggcgcgtcgtcgctgtccaggtcagcggtcaggtcggcctgccaggagacgaagttggccacggcggtctcgatcaccaagtccaaggtggccttgtccgcgggcgaaagggtctgataccagggcagggtctcgcccaggtggtcctgggcctggcgcaggatgcgccgcaccggctggggcaggtcctggggcttagcctcctccgggccgggctggtcggttcgctcccgttgccaggttcgcaggggtgagccgtcctggggcgacttggctcccttggaatgccattgcaagacgtgccacagggcgtgctccccatccgaggcccctgccgtgcttttggcggtcttgcggtttgacgggtgggaacccgtcgccgctcctgctttgctcatgcctttcagcttagccactctggtgcctgaactccggcatgttcgcgcaaggggcgcggccgggtgagagggcagggctttgtggggcaggcacaaaacatgccggcccgatttgtaggtgggaggctttcgggggtcggctgctctcaattactttggtgtttgtgcatactcacgatcacgccgaaccggcctcgaaccagcggcccgcgggcttgcgggtcctggacctgggagactgcggcctggcgtccgtagcggatttgggggtcgttgactcgaccaacagctacttggcgcgggtcctggcagactcacccctggaagacgcccgggagcgggtggctggggtattcgcaggggatgggtctgaacggtcggtaaccgaagcggggccagcggcgccgatcgtgctcagcctcgccttgactgacgaccagacccggggccgtgggcggctcgaccggtcctggtacagccgggccggacagtccttcttaggcacctgggccgcggccctgcccaccgacctgctgaccggccccgcttcgggttggctgccaacggcggtcgggctatcgctgatggaagggcttcgggaggtcctggcctcctgcggagcgcaggcgctcgaccaaggctcgcctgacgatggcacggctcgtgatggcctggagggcgatggcctcgctctcaaatggcccaacgacgtgttctgcgcgggccgcaagctggccggcgtcctctgcgagagcctgctcatggagggtgggtggtccattctcatcgcgggcgtaggactcaacctcttcgtgccggcggacgatctgcccatcgccggttccacctcacttcagctccatttcggccccctgccggcgtacaggcctcttcgggacgggctggcccgcgcggtcagcacccgtctgcccgcccgcctgaccgacctggctgctggtggggatgaggcccgtctgtccttgcgccaacaggccctggcaaatagctggaccctgggccgaagggtgcgggtgaacccggtggccgctgcggcagtggaaggcaaggcgttgggaattggcctggacgcctcgctggaggtcctgttggatgatggccggagaatcaacgtatccacaggcgacgtaggcgtgctgcccgaactggccgagcctggccaggcgggcgataagcgagtgaaaggacagcgcggatgaggaagctggtcgtagccaatcgcggtgagatagcgctcagggtggtgcgcaccgcccgggagatgggcatcgccactgtcgccctgtacgcggagcgggaccgccaggccccatacacgcggctggccgacgaagcctatctgttgccaggcgacaccaatcagcagacctacctgaacgaggacctgatcgtcgagaccgccctgcgctccggcgccgacgccctccacccaggctacggcttcctttccgagttctcctccttcgccaccaaagtcatcgacgccgggctcacctgggtgggaccctctccgcgagtgctggatgagctgggtgacaagatcaccgcctgcaaggtggtcgatgcggcgaaagtgcctgtggtgccggggctgagcgagccagtgaagtccatgaagaccctgctggccttcgctcatgagcagggctatccggtcatgatgaagaaagcggatgggggcggtggacacggcatcacgctgatctccaacgacgacgagctgcgcgccttctacatgagccacgacaccctccagggcggcgacctcggcgattacttcatcgagaaattcgtggacaaggcccgccatgtcgaaacccaatccgggcgcgacagccacggtcgcttcaccgtctactccactcgcgactgctcggtgcagcggcgcaaccagaagctggtggaggaggcgccggcccctttcctgccggcggaagtgaccgagcggctcaagacttactcctactcgctcttcgacaccgtaggctacgtagggttgggcacctgcgagttcctggtgacccctgaggacgatgtctacttcatggaagccaacccccgtttgcaggtggagcacacggtcagcgaggaggtctgcgggctggacctggtgcgcgagcagttgacgatagccgacggcggcgagctgaccgaggcgcccgacccgcgcgggcacgctttcgagctgcgcatcacctccgaggacccggccaccaacctgaccccggcctccggcacaatcgagtcgattagctggccctcgggccctggcatccgcgtggactccggcgtacaggtgggagacacagtctccccgcgcgacgattcgatgatgggcaagctggtcgtgcgggcccaggaccggttgacggccgtggcccgggtccggcgggccttggaggagctggacctacaaggcgtgcccacgcccgcctcgctctaccggaagatcttctctgatcctgcctttaccgccgaggaaggccaccccttcacggtgaccaccaagtggctggagcgcacctacttgaaccaggagccgcaggcctcagcagcgggccagccggcatccatgagcgccggacgacccgattcggcgccggccgccggggcgggcatggagaccttcgccatcgagattgatgacaagcgggtcaaactcgccctgccgcagcaggccctggaggctctgggcgcgggctcgggcggccacgtcccgcgtcggccgcagcagcccttgcgcgggcagggcgccagggaccaagccgtgaacgcgcaggaccaagccgagcgttcaggcacgattgtggccagtatgcaggctgtcgtaaccaggatcaaggtggccgacggacagccagtggacaagggcgacctgttggtcgtgctggagtccatgaagatggagaactacgtgtatgcgcccgccaaggggaccgtgcgctccatcgacgtcagcgtcggtcagggcgtggatgccggtcagaccttggctcagctggacctgggctcggccgacgaatccgaggacgacggcgaaagcggcgccgagcagcgcggccgccacaagcgcgatgcgatcgaagaggcgagcgacaagacgggagggcggtgatgagcgcgatggtaacggcggaggaaaagcgccggaagctcggcgggcaagcccaggcccggactcaagaccggatccagcctggccgaggtgaagccagcgacccgacgggcagccagggcggaagccagccccttgccagtgatcaagcccggagccaagggaacactgagaacccggctggcgggcgcaacgccaagggcgcgattcgccgggccgcgcagttggcccgtgaggctgagcggaacgctcgcgctaagcagggcgctaagggtaaggggacggcccgggagcgtctggacctcctgttcgacagcggctccttcgaggagattggccgcttcgctggcggcgacatcgaaggagggcgggccggagcggctgtaatcactggcttcggtctggtctacgggcgcaaggtggccgtctacgcgcaggatttctcggtgcgcggcggcacccttggcagcgcggaaggggcgaaaatctgccggctcatggatcaggccatcgatttgggcgtgccgattgtggccctgatcgattcgggcggcgcgcgcatccaggagggggtcgcggccctgacccaatatgggcgcatcttccgcaagacctgccaggcgtccggcttcgtgccgcagatttcactgatcctggggccctgcgccgggggagcggtctactgcccggccctgaccgacctgatcatcatgaccaagagcaattccaacatgttcgtcaccggacccgacgtggtcaaggccgcgaccggcgagacgatcagcatggaccagctgggcggcgggcaggtccacgcctctgtgtccggtgtggcccactacttgggcgaggacgaggcggacgcgatcgattacgcgcgcaccgtcctggcctacctgccttccaactgccaggaggagcctccgacctacgcttacgcctccggccgcgccgagcaggccgccgccaagcgcctggccacgatcgtgccttccaacgaccgccagccttacgacgtgctggacgtgatcagcgccgtagtggactatggggagttcgtccaagtccaggagcttttcgcccgttcggcggtcgtcggcttcgcctgcgtcgaagggcacccggtcggtgtcgtcgccaatcagccgttggtggacgcgggcagtctggatgtggattcatcggagaaggtggcccgcttcgtgaacatgtgcgacgccttcaacctgccggtgatcaccctggttgacacgccaggctacaagcccggcagcgaccaggagcacgcgggcatcatccgccgcggggccaaggtcatcgccgcctacgccaacgcccaggtgccgctggtgaccgtcgtgctgcgcaaggccttcggcggctcctacatcgtgatgggttccaaggccatcggggcggacatgaacttcgcttggcccagttctcagatcgcggtcctgggcgcccagggcgcggtcggcatcatccaccggcgggacctgcagaaagccaaggaggaggggcgtgacgtggatgccctgcgtgagcgcctggccgccgagtatgaggagaagacggtcaacgccaacctctccctggagatgggcgagatcgacgcgatgatcgacccggagcagacccgggaggccgtcgtcggctccttgcgcaccctagcctccaagcgcaggaggcgaatcgtggataaacaccacggcaatcagcccttgtaaacgcataaattcaaccttttacacccatagagccgcaccgaacgagaaataggacaacatgacaaacgcattcttcatcaaccgcctggccgaccagcctcacgccctcatcttcgctggccagtccactccctggccctcagccctggctgacctgtgccaggacccgacgttggaggaggccctcaaggggcacgccgaatcagcgcgccggatgctgaccgcagtggcggcggacctgctggctaccgacgggaagccgctcgacctgttcggctaccagcccaagggcgcgaagctgggcgccgccgccgacgcctccgcttccgtgcctggcatcgccctgactcagctgggggctttgatcgacttggaccggcttgggtacgacttcgcctcggcacgccccttggccgtcctgggccactcgcagggcatcatcggcgtccacatggcccaggccatccaagaggcagggtccatccaggccgcggaaggagagatcgaccgcatcctggccactgccatgctgattggcgcggccggcacccgtcaggcccgtaggctcggcatccacgcccaaggcgaagccacccccatgctttcggtgcgcggcgccacccgtcggcaggtggacatcctcattagccgcgtcccttcgccgaagggcccgattggcgtggccgtcaccaactccgaccgccagctggtcctgtcgggatatccgcaggacctggccgcgttcgaaatcgaagtaggcaaagaggctgaccgccaggccaagatgcgcgaggagaaagtgcgcggcggcacgcccttcgctccggtcctggagtacctggatgtcagcctgcccttccattcgtcgttgatggcggacgcggtggatgaatgcctggactgggctggccgctgcggtctggacgccgaccgggcccagctcctggcccaggaagtcctggtcaaccacgccgactgggccgggcaggtgcgttccgtgctggagtccaacgaccccagccagctttggctggtggacctgggtccgggggagaccgtgggcaagctggtctccagcctgacccagggcaccggcatcggcatcgtggaagccgcgacagccgcgcagcgcgcggccctgtccaccctggagggggagcctgagcgcagccaggattggcggcggttcaagcccagcgtcattgatacgcctgccggacgcaggatttcgaccgctttcagcaggctgaccggcaagcccccggtgctcctggcgggcatgacgcccaccaccgtggagccgggaatcgtcgcggctgcggccaacgccggctactgggccgagctggctggcggcggccaggtgtccgccgaggtcttcgaccgccatatgcgccagctggaggacgagctggatgaaggtcgcaccgtggagttcaacgcgatgttcatggaccgctacctgtggaacctccagttcggctcccaacgcatcgtttccaagaagcgtgagtcgggcgcgccaatcgacggagtggtcatctccgcaggcatccccgagcaggacgaggcccaggctctgatcgaccgcctgatggctgagggcttcccctatgtggccttcaagccgggcacggtcgaccagattcgccaggttgtcgccatcgccaagcaggtggcccccaagcccatcctgatgcaggtggagggcggcgctgccggaggccaccactcctgggaatccctggacgacctcctgatctccacctacgcccaggtgcgcgagcgccccaacatcgtcctggtcgcgggcggcggcatcggcacccccgagcgtgccgccgactacatcagcggctcctggtcccgcgagtacgggatgccggacatgccggtggatggtgtgttggtgggcaccgccgccatgaccgcggccgaggcctgcaccagccccgaggtcaagcgggccctggtcgccaccccaggcatcgacatgagccagccggaccccgaccccttcgcgccgctcggtgagcgctgggtgccctctggcggttccgtgggcggcgtgagctccggtctgagccacctgcacgcggatatttacgaactggagaacgactcggccgtttgcggccgtctgctggtgcgggtgatgaagcacccggaggagctgcaggatcgccgggacgagatcatcgatgcgctcgcgaagaccgccaagccttacttcggtgacttggaaggcatgacctaccagcagtgggccgagcgcttcgccgagctctcctacccctgggccgacgacacctacgtcgaccgcttcctgcatctgttgcgccgggtggaggcccgcgtgcagccgctggagtcgggcgaattccaatccatctttacgggtcacgatgatgtgagcgagcctgagcaagccctgcgccggctgcggcaggcttacccgcaggccagcgagaccaccgtcgtgcccgcggacgtggcctggttccccacgctggtgcgtgagtaccccaagcccatgccgttcgtgcccgtcatcgacaatgacctgctgcgctggtgggggcaggaccagctctggcaagccgaggacccgcgctatggcgccgattcggtccgcgccatacctggccccatctccgtggctggcatcacgagcgtggatgagccggtcgcttcgatcctggggcgcttcgagcaggccgccttggagcgggtggcaggcgaggagcggaccaagccggttcaggcatacgccgagctggcttgcgcggcttcagccgaggagttcatccgccgcagccctcacatctcctgggtggggcatctgaccaacaaccccgcctatggcacgcccatgggagatcagcattacgagattcgcgcggcgggcgctagccaggggcttgagcgctacgacctggacatccacctggacaccttctgggacgatgagcccggtgggggcttggacaagcatgctgtgcgccatatcgtcatcccgctgaccctggacccgcgcgccgccggttccttccccgtggtcgatcgtgagcgcctgcccgaacacgtctacgccctgctggaagccacggcgggcatcggcaacaccgctatcaccggagaccggctggaggccatgccagccatcgagcagatggacgacaaggccacttatccgtatggacgggcccatgcttcgtatacgctgagccccagcctgggcttcgatcacgaggcggtcaccggcgcggccttgcccgcgagcctgaccccttcggcgattgcgccggacgcgctggtcggccccgcttggccggccatctacgcggccttgggttcggtctacgtggaggggctgccgattatcgaaggcctgctcaacgcggttcacctggaccacctgattgagctggaggtcgatgaggacgagctgtgccgtcgcgccgggcagcggatcgagctcacctcctgggctgaggactaccgggaatccgcttcaggccgcgtggtcacgattcatgtgcgccaccaggccaccgatgggacggtgctggctaacgaagtggagcgtttcgctatccgcgggcgcgcctacagcgaccagctgccccagccggcccccgactatggaggcatcgaggcggaccgggtcgatacgccccgccggctcctgcgtcgggtcagcgtcaccgccccgacggacatgactgccttcgcccgcacctccggtgacttcaaccccatccacacctcggtgcgtggggcggcagtctccgggctcgcggccccgctggtgcacggcatgtggctctccgccaccgcccagcacgcggcgcaggccacggacgagcagggctcccattacgagatcgccggctggacctacaacatgtacggcatggtgcagctgggcgacagggtcgagatttcggtcgagcgtgttggcaaggtccgccacggcggcctggtcctggaagtcacctgccggatcgacggcggaatcgtttcacgcggaacggccatcgcccgcgcccctcgctccgcctatgtctacccaggccagggcatccagcagcagggcatggtcttggacgaacgggccaagtcacccgccgcccagcgcacctgggagcgcgccgatgccttgacccgctccaagctgggcttctcgatcctggccgtggtgcgcgataaccccaagaccctgaccgccaaaggcgtcacttaccaccatccggaagggcttctgaacctgacccagttcacccaggtggccctagccacggtggctttcgcccagaccgcccgcctgcgcgagtccggcgccgacgtgtggcccgcctacttcgcagggcactccctgggcgagtacaacgcgctgagttccttcgccggtgtcatgtcgctggagaccgtcctggagctggtcttccaccggggctcgaccatgcacgcgctgattgagcgcgacgagcaggggcggtccaactaccggatgggggccctgcggcccaaccagttcggggtggatgacagcggggtcaaggagtacgtggagtccgtctccgccgaatgcggcgaattcctggagatcgtcaactacaacctggctggccagcagtacgcggtcgccggcaccatcgccgggctggagtacctgcgacgcgactccaacgcccgggccaaggaggcaggcggcaagccggccttcatgtacgtgcctggcattgatgtgcccttccactcctccttgctgcgcaagggcgtgccggagttccgcgacacgcttgacgccctcctgcctgagcacatcgactacagccgcttggaaggccggtacatccccaacctggtggcccgccccttcgagatgacccgtgatttcgccgcctccatcctgggggtcgtgccctccgagcggatcaaggccgtcctggacgacccggccctgtgggactcctatgcggccgatgaccagcggttgggccgtctcctgctgaccgagctcctctcctggcagttcgcttcgccggtgcggtggatcgagacccaggcgctgatgttcggatcgcgcgagcagggcggtctgggcgttgagcagttggtggaggtcggactgggccattcgccaaccctggcgaacatggcctctaggaccttgaagctgccggacatgcgcgagcgccaggtcacggtctacaacttggggcgtgacgaggcccgggtctacctgaccgacagcgacccggccgcgccgattgccgacgacgagcccatcgcccccgcctcgccaacccagatggaggagcttgcgcccgcctcggcggctgcagccgagcccgctccatccgcagccgagccagctgcccccgcgcctgagcccgccgcgccagctcagtcccagcaagcggccgcgcccgctgcgggagcgtcttcgggcgctgatgtgggtgacatcccgttcaaggcttcggacgcgatccaggccctgctggcctattccacgaaaatccgccctgaccagattggcgagagcgacacgaccgatacgctcaccaacggtgtctcctcccggcgcaaccagctgctgatggacatctcctccgagcttggcgtggcttcggtggatggggctgctgaggcctcgatgggcgacttgagcgccctggtcgactcggtggcgcccaactacaagcccttcggcccggtcctgtccgacatcgttcgcgaccggatcaaggccctcttcgggcccagcggcatcaagctcaagcaggtggaggagcgggtcaacaatgactggctcctgggacccggctgggcggcggccaccgtcgtcagcctggtcttggacacccgcgaagggtcctccgcgcggggcggcgacttggcccagctgcccacgcaggcggtatccaccccagctgcggctaaggcggtgattgaccaggccgtgcagcgcgtggcccaggccaagggcgtatccgtcgccctgcccagcgctggcggtggctccggttcggcggtcgtggattccgcggccctggacgctttcgccgcccaggtcaccggctcgcagggcctcctggcctccacggcacgctacttgctcgatcagctggggttgaagccagctgcccccgctccgggcgagaacgaggacgcggccgtcgtggccgctgtcgatgccgagcttggctccgattggccgcaacaggtcgaaccggccttcgatgagcgtaaggccgtcctcttcgacgaccgctgggccaccgcccgcgaggaccttgcccgcatctggttcgagggcgatgaatccagtcaggcggccagcttcctgggcgccggacccgaggtaggggcccaagccgtctggtatgagcgtcaagcgcagcaggctggcagggctgatctggcccaggtcttcacccgcatcgccgatgaggccggtcgggacccctccgccgaccccaagtccagtcggttcgccaccgatgtagcggtggtcaccggcgtatcggacaattcgatcgccggatcgctcacagctgggcttctggagggtggggcgaccgttgtggccgtcctgcacggcctggaccagaagagcgtccagtgggccaagcggctctaccgggagcacgcggtcgctggcgccaaactgtggatcgtgcccgccaacctgtccagcttccgggatgtggacgccctggtcgactgggtgggttcggcccagcgtaagaccaccggcgccacgaccaccatcttgaagccggctctggagccaagcatcctcctgcccttcgcggcgccgcccatgcatggcacgatggcggattccggcaagctcttcgagtcccaggccagactcatgctctggggcctggagcgcatgatcgccggttttgcgcggatcggcgccgatacggacgtggaccacaggctgcacgtggttttgccgggctcccccaaccggggcgttttcggtggcgatggcgcttacggcgagatcaaggctgctttggacgcgatcgtcaaccgctccaggagtgaacgcgactggtccgacagggtgaccttcgcccatccgctgatcggctgggtgcgcggcactgggctcatgggcgccaacgaccccttggtcgcggcggtcgagcggcaaggagtcaccacctactccaccgagcagatggccagccaacttctggacctgtgcacgcccgaggcccgcaggcgcgcgctccaggcccccatccaagccgacctgaccggaggcttgggcaaggagcccatcgacttgcgcgctttgaaagccgaggcggcgcaagaggccacggacggcgacggcagttccgccagcggctctgacgcgggcgcaacgggcgctggctcgggctctggtcaagacagggaccgcatcgtcaaggccctgcccaccccgcacgtgccccatcagccccaggtcgatttggccgactggaagggcgtgaccgcccggcccgaggaccaaatcgtcatcgtctcgattggcgagatgggcccctggggctccggccgcacccgtttcgaggccgagttgggcatccattcggacggccaggtggagctctccgcggccgccgtgctcgaactggcctggaacatgggcctgatcgagtggcaggattcgcccaagcccggctggtacgacgcggctggcaacttggtgcccgaggaggacatcgcggagcgctaccatgatgaagtcgtggcccgctccggcatccgtcccttcgacgatgggatgggctcggactataagcagggcacggacgaggaggaggccgacgtcttcctcgaccacgacgtggtcttctcggtgcccgccgcttcgatagcccaggagtacgtcaaactggacccggagcacacgggtgtggagcgcgacgaggagtcgggcgagtggaacgtcacccgtcgcaaaggctccaagattcgcgtgcctcgacgcgccacgatgacccgcacggtcggcggccagttcccgaagggcttcgacccggtcaagtggggcatccccgcctcgatggtcggcaatgtagacccaatcgccctgtggaacctcgtgaccacggtggatgcctacctgtcggctggcttcacccccgtcgaggtgctgcaggtcatccacccctccaagctggcgtccacccagggcaccggtttcggcggcatggcctccatgcgcaagctctacctggaccgttacctgggccgtgaaatccccaccgacatcctgcaagaggccttgcccaacgtggtcgcggctcatgtgatgcagtcgtacatcggcggatacggcaacatggttcagccggtctcggcctgcgccacggccgcggtttccctggaggaaggcgtcgacaagatcgccctgggcaaggcgggcttcgtcgtcaccggcgccatcgacgacatcggcgtggaatcggtgatcggctttgggaacatgaacgcgaccgccgattcgggcgagatgctcgccaaaggcatcgccccgcgcttcttctcgcgggccaacgaccggcggcgcggcggcttcctggagtcccagggcggcggcacgatcctgctgacccgaggcgacatagcgctcaagatgggtctgccggtggcgggcgtggtgggatacatccactcgttcgccgacggtgcccacacgtcgatccccgccccgggcctgggcgccctggcggcaggcatgggcggcgccgagtccgacttggctcgttcgctggccaagctgggcgtttcgccggacgaggtggccgtggtctccaagcatgacacgtccaccaacgccaacgaccccaacgagtccgagctccacaacagcttggcgcgcgcgattgggcgcacggagggtaacccgctctacgtcatctcgcaaaagagcctgaccggtcacgccaagggcggggcttgcatcttccagatcaatggtttgacgcagctcttccgctccggggtcatcccagccaacgcctcactggattgcgtggacccgaagatgcggcgggacgaccacctggtctggttggagcagccgctgcgggtggggtccatcaaggccggcctggtcacctcgctgggcttcggccacgtctccggcatcggcgcgattgtgcacccgggcgccttcgaggcggcggtcgcccagagccagggcgagcaggccctggaggagtggcggaggcgggccaacgcccggctggccgccggtcagcgccgcttgcaagaaggccgtatgggccgtgccaccctctacgagtcgattgacaaccggcgcttccgtgaggacgcccccggctacgacgcgcacgaggtcgagaaggccatgctcctgaaccccgacgcccgcttgggtgaatccggctactacgaggcctgagcgcaaaagcaatccgccggcccgcccctcaactgggggtgggccggcggattgcttgttcgagcttcttaaagccatgcagggagggcggcgttgatccggtccaccagggccctggggtttgcgacacctaagaccaggcgggagtaaggctcaccggtgagttggatgacgactggacgttcggggcgggccacgttccaaaaggagcgctcgccctggaggacgaagctgccggcccacaggccgccgaccgcggtgcctgggtcgcgcaggcccttgggctgatcgaggatgccggggtcctccgtggcccccaagacatgggacatgggtatttcaattcttttttttgagggcgaggaccttgtggatttccctcggctcgatgacgagcttgtcgccctcgaaactcacgctattactggccttcatgattgcctccttagtgcttgtatgattgtgcgctctgagtcagcggccggctggccgatggctgccgggcgcatggtgtttatcgttggtcgggctcgtccacttggccggaggggaggcccctcggtggttgggccacttgcttagccgccggccgcttgccctgggaggcagtcccgtcttcgctcagctgcgcgcgtttgagcagcgcttgtcccaatagccgggctatgcgggccgacctttcatggctgggtccttgggcctcttgcgctggtgcgggcagcggcagggcggcgaaatagcgttcaagcaggccttggatctgcccgtcgctggccgacagctccatcatcgccaccaatgccacttccagtgcttccgcacttgctttgccgggcttaaggcttttgcgcaggacggccaggaagatgccgcgcttgctgccgaaggcggagtagagacttccgcgcaggagtccggtggccttcactaggtcgtcgattgaggtgccctcgtatccgtgtgccaggaaggcttggcgggcctgcttcagagcctggtccgtgtcgaaatcgcgatgtcgtcccatggcgacaaccctatcatatacttgaacgattggtcaaaaaatgggacgttatcgccgtatgcaagttccacaccggtaatcagcttccgggctcggcctgttcctgtacccagccgaggccatactggaagcatgagtgaggagatgaagggaaagcccgcctggccgggtggtcccgcgcctacccgcctgttgggtcttgggcacgacatcgtgagcgttgagcccttcgcccagcaactggctgagcctggctcacggatgcgcgacctcttctcgccgcgcgagcaacgccagtgcgccgagcgttcccgattcaagggcgacagcgaagccgtccatctatccgcccgctgggctggcaaggagtcggtcgttaaagcctggtccgcagcccttggtccccgccccgccccctacaccctcgacgatttcccttgggcggggattgaaatactggatgattcccgttcccgccccggcgtctaccttgccgatgaagtccgtgaccggctgtgttcgtcactggagctgacagccgccccaatctggcgcatctccctgtcgcatgacggcggtctggcctcggctgcggcggcgctcgtggtttggtaggggggggtaaaaacgcccgcaacgcgatgaggcgctgcgggctggtattgatcaagcacatttgcgggcatgacgagaccgtgtcgccccccccccccggggtgtggattgaatttttccggtccgttgggcaagcgttagtgttagccccccccccgtagggagtgaattgcaagctcggtctttcgggttgattatgcgggttcgtttgttgtctgtgttgcgcctggaggggattggatgcagattagtgggcttgtgcccttctggtttgcggacggttctgtgatggaacgtggaagtggacggggttggcgtttcggacagtttgacaggatgggctggctcgcttcataagaaggcttgtggggctggcgtggatatgtcatgtatgcgctgctggtttgcttcatgcgtttggtcgggtgctgatggcgtatgcgcaaccgggaaggcaaaggggtgtgctaagctctgaaacgagcaagtcacttcgcggatgtagctcaatggtagagccttagtcttccaaactaattacgcgggttcgattcccgtcatccgctccattgtgaatgccttgtagcgcaaagggccaggcctctatttgaatcttttacccgggttttacgcgagtgtgatgttattcgcaacgagctcttggtgccggtgtttgatcatgtggtttcgcccaattgtccgctccggggtgagtctccggagacggtagccaatggctgctcggtgcgggtccctcgttcggggcgcagaggtttccgggtcgctggagttgggcttagcggcctacctaggatggccagcagacagcccttcttccgggcctcttggcttcagtcagtgggaaggctctcgctgtcgctcgtgctatggctctgtgctgaggtttcgggaatcctgggaactcatcgtagactgggcgtaaccatgccagaaaccggtgggtgtaggaatcattgggataggggatcggcggaacagaacaccgaagtggtggaagtcaaaattctcaaagcagccgttttggcttcttggcttgggcagtataaaagagtctcgctgacgtcggcgttgccgacaaggctccgaatgcgcggatggttgtcactagcagtcatccgcacgtttcaacctcaaggtctttctgccatattgatgtagagatcgtagattttgggatggggtcaaaagcggtgagggtaaggtaaaaggcgtctgctctgttacttaaagattttttcgccggattactgccttacaggtgtcctgttttaatctccggcttagtctaagttctcggatccatcaacctcgacgtcaaagccctggtggggcgttaccccgagcacgggcacacggcgaccgcgcgcagcatcgccatgctccccggcggcaagggctcgaaccaggctgtggccgccgccaaactgggcggcaaggtatccatgctgggccggttaggctaggatggggccggcaaatagatgctcgacgacctggacgcctggggagtggacaccagattcatctccaagagcgctcaggaaggcactggcaccttcatcgcggagattgaccagacttcggggaacacgatggtcggcaccttgggagccaatgccaccatcagcggtgaggaggtcagtcaaaccctgggacagattgaggcacccgtgcttcttcttcagttggagaccagcaaggagtccgccatggccgctttgaaaacgggcagggggtaagggcatgtacatcatcctcgaccctgcaccggccgacggtttcttccctgaggccctccaataagccgattgcgtcactcccaaccagcaggagacagaacggattaccggaatcaaggtaaccgacagggttcaggccatcgaggcggctaaggccatagccaagatggggcccagtaccgtcatcgtcaagctgggggccgacggcagcgtggtcttgcatgaaggtgagatttatgaaatcgattcggtcaaagtcaaggcggtcgacagtgtgtgtgccggggacgtcttcgctggggctcttgcagtcaattattcccagcaccgcaatttcctcaacgcggtgaacttcgccaacaaggccgctgcgatcaaagtcagcaggatcggcaaccatgatgccttccccaccttggcggatatgggctgagacataccgtgacaggcccttgccgctggggcaatgcgtgcgcataaaatgcgaaacgctggatatagtggcgtaccgggatgccttggtgtgtacatcccttggcggagtcggtgatacgccactggttcaccgcctccgccgcaaaggttaccgcaggcgggggttggagggcggcgaagcttattccgctgccctttctccagcgtctcgcggttgcatgggttgttgaaaatatcacataatcgctcccttgcaggctgtgaaggcattgatggattgccgggggtcgggttcggcctaggagggcaggaagtgacatgtagcacgcgcgcaagcagggcccaatccgcagatctcctcactggtcaaggccctgactggtggccatcctgatcgccttggcggcttgagacttaagctcctgcggggcatgtaccccccccccggaaaaaaagactaagcgtctgccgctgaggccgcggacggtgcctttgcccagcatcttgcggcggtcgcctccaacaatatgggcatgcgaacgacgcttggcgagttcgaggactacggttcggtcccccatcagcggctccctggcgctgttagggaccagggtgattggtggaccatccgtggggttcatggccttccccttccttctcccgaatgtggacgagggcagtggagccgccgacaatccctcgcgtaacacggattcgggccaggcgagccaagccgggtcaggccgccgcctctttgatcatgtatgccgtcagcaacagcgcgttcggcggcaggaacatggccatcaggtccacgctgacaaatcgagggtgggtggcgattacagcatgagcattagcgccagtgaggcggcccgccaacggaccaaggcgcagcccagagcagggcgcggcgatcgtctccgccctgccgggttcgcgcatcgtatgtcttgacatcattggcggtgctttgtatcttagaagtgtactttcctggatgcaacgagtgtattggaccttcggttaagcgagtccaatattgctgggtgtgttcgacctaagggtagttggggatggtgcaagaaggcatgggcagctaggatgggcttatttcgcataccggggaagggtctcggccgctagaaactttggtataggaaaatgaaaaagctgactattaaatatactttgaactcagcaatggtcaaagtggcggtatctgtgctggccgtggtcggtctttcggtactgattctgcttgctcctccttctccggaatctgctagcgcggcaccggtcggcactggaggcgccgcctccaaaccacagttggcgcatacaaaagcaacgaacggctgggtggatcccgggtggaagaagataccggacctgcaggcgcactggctgcgccccttgaatcgcgataatatttactggaccacagcggcgagcaacggtgtcaccaatccagtgggcagtgtaacgaccgtattgagcgaaagctatggatggtccggcgacacgtacaagacccgtcccacgatggaattctcgcggacctcacctggcggctcgtcgggcaatatcacagggcctcttatgttttccagccaggccatgggtgtttatggggatcccccggcagattccagtggacagcagccactgacggtgtatttctggtctcatgatggcagtaacaaccaaacttacatcagcaatagcaatatcccaagtggttatatacccgtcatccgcaccacaagcggcgctgccaacgacacatattccgacatctacgttggggttatgcctgctcccggaactaggactggggatagtgccaacggatggtcccacggtccaggggcgggaccagtggcgggagttgacctttcgtccacaggaggggaggtgagtcaggtcaccggttacctctatacttcaacccgtccgtatacggaaatcgataacacagccctgataagtaccgcgcctacccagtctgcttcgcagtactgcatttgggacccgttcaccggcaattattccttatcgcacatggtccaacccggagactggtctccggggatgaccaagccttcaatggaccggtgggccttgcgtcgagatgtgggggacaccagcaccgggccagtcgatcaggctggcagaccgcaaagcgtggctacgggttcgactaccgccagcgcggatatgggtttggatgcattaggtaatgcgtacctgtattacggcggtgatgcggtgccggcaagtggtttgggctacaacgcaggtattgcgaaaatcgccccggcccgctctgcaactggcgacattctagatggtagtccgaataatccttggcgctataccaatgtgaccaaagtgcgctcacaattgggtgagagctggagcggtgctggcaacgcgtggggtgtgggcatcagaaacggcaaattcctgattggtacgtcgattaccacctatccaggaccaggtgaatccattccgggaaccagcggcacgcagtcccgactcgtcagtatagaccctctctccggcctcgggaagattatgggatccagcgataatgcccaggggcgcaacaacaacacttattacgtgcccgctactaatacttcatacgacatggcttcgcctcaggggcttatggtcattcaaggcagcgtgtacaacgacgttgacgggaatggttcatccgcgtcggacgggggcagaccaacgaacgcgactggtttgcccaagcagacgctagcgctgtatgattccaacaaaaggtttttgggctccactgtgacgtcggcgctcggcgcatactcctttatcgtcgcgagcaccggtaagtattatgtccgtgccgtgcaacccggtgttccgcagcccgacggcactgtcatagcggctcaccagacatggggcgcctcaacctccggcagtattggcagcggagatgcccttaagaccaatgtatcgactatgcgctgcttgacaggaggcatttccaatcctgcagggagggcggccgatacctgccaaggggcgcttcaagctccttaccccgataagaacatagaaacactcggacagatgggcaatgaagctgattggccgttctatggcaccgtggatatccagaccggtgctattattcctgtgctcgatttcggtttcagcaaccagggcagctatggcgatgccagcaatcctccctattattcgacgaatgcgcaaaaaggaccggtgctccagtccgctgatcaaaatgatttgaagctgggggagcatctgggcttttacggggatggcaccaacgactccttggctaataagcatactacggacgatggagtgactatcaagttcggtgacgggacggttgctcccttgcaaggttccgcgttcgtgcgcgggcgctcgtatgatttgaatttgaatgtcggaggccgccttgcggccaactcccatgtgagcgtttggcaacgcaacgccgatggcacagctgctgcaggacccgcaaccagcgacgcggtagcgggggataacatagtcagcatcagcatgccggctggctctggcgctatcgcgaagcggcagattagggccatggtcaccccaaagagcttcactccggcggtcgacgatacgggcggcggctttgcccgccatcccgcgggtgcggcttcgaacaacactgcagcttggacggtcccgggagaggttgaagattatggggtgtacttggccggggctttggtgcggttgcaggtcaaggttaacaacggtaccgtaccggcggcgccgttcaagtacgccctaacgaacgtggacgagggcgatggtgctgcagacaacccatccagcagcactgactcgattacggtgagcggcatcggccaagccactacttcggcgacggtgcatgcggtcactgatgctaccgctggcaataaaggtgtgaaaatcactgatgtgaccaataaggcaactctcggcagtgaatacagcatatcgagcatcacctgtcacggaaccacggacaacgccaatttccccacagtggtctcggccaatgaggggactgcgacggtaagcgggatttcgtccggagcggatgtcacctgtcgcgttgagtacgacaatcatgctcgttttcttattcccaagacgggtgttgtagctgtgcggtatcagacgggcacggctttattgttgctgtcggtaagcggattggtagctatgcagctgaggaagcgcttcagcgctaagcgttcttcaaacgctcgtcatatttagcctggcccgaagagcaattatgcttttagccgtgtgtatgagttcggctctcatactctggcggccgtgaacctcggcggtgagccgcacggcgattggacgcggctgaaagccatggttgcgttccctcagtaacttgctggctatcgctttgcctcatcgcagacgtgttgaggcgctcggggaacgaccacctgggactacctgggttttgtgcggaggaagcatgtgcttcgttttgccgttgcgaagccatgtttttggccggcgagtggcgtggtgataaatgataagaagtcggttaaggcctgattccccaagtatgagggagatggcgcacggagtaagcgtgcgtcgcagtgcatttcttgtgtgggcaataaccttcgcctgagaccctggcgaagcatattgcggcgtttccgcatgccagcaaggtcagagctcgtaggtgcacgttgggtcaaattagcggttccgcgggcgtagattaatggtagaactgctgtcttccgggttgactacgtgggttcgcttgttgtctttgctgcgcggggaagggattggatgcggattagagggcttgtgcccttctggcctgcggccggttctgtgatggaacgcggaagtggacggggttggcgtttcggacggttcggcaggatgtgctggctcgcttggtaagggatcttgcggatttagcttggattctgatacgtatacattactgttgctccattgggttctcgcgctgctctgggcgcggcggttcgcactcgccttacggggcgtccgttggtatattcgacggtgcgccgtaaagtggttggacggggccaatgtaggctgttctgttggggtgtccaggagggatgcggcaatgccggatgcgggttcaagagcgtacgctttatcggctcaggcggcctcgatttggggcaagtcggattatggcgaggacaggtcatggctgcctctggtgatgcacatggcggattcgagggcggtcgccggcgaactttggaatcagtgggttccccagggtactaggggcattatctcacgtggcgtcggtggcgatgaggccctagcgagaaagttgtactgcttcctggccggagtgcacgatatagggaaagccacaccgaattttcaggcgcaaaactggggtttccgcggtggcgacggcaacgggctggcatggaagccgcagcaggctggcttgccgattgccgctagtttgagcggacggtcgaaactcagccaccctatcgctgggcagattattctcaacaagtacctgtacgagcactacgcctgggataaaacgctgtctgattcatactcttgcatcgtgggcgggcatcatggcaagccgcctgtcgcgagtgatttaagggaggctagggagtatcgactggtcgaatccggctgggcttcgcaatatgagggcaagtggtgcagggttcaggacgagctcgttgagttcgtgcgggctacgagccatatgtgcgatgcggacttcgcggctctggcgcggagtgaactcccgcccatggccgaaaccatcctcacaggcttggtgattatggccgactggattgctagcaacaaagattatttccctctgataacgcttcgtccgcaagatgaggatgaacgttttttcgagtctggcacggtgtccctgtctgcgctcaagcggcgggccgaaacgggttggaaggcgctgcatctcaccccttgttgggaagcgccccggcagtccggcattctggaaagcgagccagaggacttgtataacaggcgtttcgacctgccccaaggtgcttcgccgcgtccgatgcaggcggcggcggtacgcatcgcgcagagcgtgcaggagcccggcctgatgattatcgaggcgccgatgggggaggggaagaccgaagcggcgctcgctgtcgcggaagtactggcggccagaacaggtcggggaggagtgtgcttggctctaccgacaatggccacgaccgacgcgatgttcggccgggttcatgcctggctcacccacttgtccaaggattgccagcaggacagggagagcttgtatctggcgcacggtaaagctcaattgaacgaagagtttcaggggttgatgggtcactcgagctccggtggcgtcactggcgttggagaggatttaacgcaagaggggaacgcttcacggataagcggcgctagtgaatcaactgtcgttgatgaatggatgagaggccggaaaaagggagcgctggcgaacttcctggtttgcactgtcgaccaggtgctcatgggggcgctcgacatgaagcatcttgccttgcggcagctggctctggccaacaaagtggccgtcattgatgagtgccatgcctacgacgtctatatgcagcagtatttgaagagggttttggaatggctaggcgctttcggcgccccagtcgtcctcctttcggccacccttccacagcggctgagggggcagttcgcgcaagcctatatggagggcagggagtcggcgctgagcaccccgcgaccgtatgcgcccgctgtacttggcaggcgcaggaggaagcgcgggactgtcgctgcgaacgcgcagatctccgggtcgcaagcaggtggaacggttcaggacgaaggagcctcgcaagcttatccgctgattacttatacgagtggacgggaggtaagacatgagggcattgccgcttcggggcgaaaatcccaagtcgaggcccgtttcatgcccaacgatgacgctgctctggtgagtttgctccaggatgccttgtctggtgggggctgcgcgggggttgtatgcgacactgtaggccgggcgcaacatgcggctgaggttttaactgcggcattcggcttgggtgtagtcactctgacccattcgcggttcattgacgtcgataggatgaacaacgaaacggtgctgcgcgcgcggctcgggcccgaagccacgctggctaatgggaagcggcctgttaaggcgatcgtcgtgggcactcaagtcctggagcagtctttggacattgatttcgacttgctgataactgacattgcgcctactgatttagtgatgcagcgtctggggcgcgtccataggcacgcacgtggggcgggggagtgcgaccgacctgaaaagctgcgcaaggtgaggtgctatatccgcggcatcgaacgttgggcggacactgggccggtgtttgcgaaaggggtggagagcgtctatttccgggccaccctactggaatttctggcggtttccggtctcactgggcaggacgattcgacccgcttctgcctgcctgaggatattgcctccgccgtccgcaaggcgtattcgccagcgatagctggatgcatccccgcagcctggggtgaggactatgaggcagctgtcagtaagcgaaaacgggaagaagacggcaagaccagccgagcggaataccatttgctccattcggcgcaggtcatgtgtcggcaaggccaaacgttggtcgattggtttgagcgaccgctggaagtttctggcagggacgaagacaaggggcaacgagctgtccgggatacccaggacagtgtcgaggtcatcctcttggtcaacggggcggacggtcagacccatctgctgccctgggtcggttcaccagagcatcggattgaagcgggcgctgcggtgaataccagcgcgctgccaagtgaagatttggccaaactggtcgctcagtgcacagtcaggctccccctttctatggggcaaggtgacgcgctcgataaactcattaatcagctagaggacttatgcggtgccagaaccgctgcttggcaggactcgcgctatctcgcaggtcagctggtgctcttcctggaccaatcgacgcgggataggttcagcgccgtaattaacggctatagagtttcatattcgcgagagtctgggctgaccgctgaggaagaagctgcctgattcgctggggcgtctggggcgaggaccacgctttgctcatccccatgaccatgctatattatttctacataatccaatcagctagatttccctctgtgcagagggatgatccttgattcgattaaggattgcggtgttccctgcatgcgcagggcggatgtggtgcggtgggggctctggacatgcactttggaaggcaacgaaaagactagggggtctgacatggagcagtcgcgaagttggttcaacttagtggacgaaccttgggtttctgtggtttacgatgatggaacagcgcaggatgtctctatatctacgctgtttacggacgcccccgtcatacgcgaacttggtggcgatataccccaacagaagttgcctttgctcaggcttgcgctggcaatcctctatagggcctactacggtggcgtggaacagatgacggaccaagactggcgcgcggattgggcgcagacatgggtggatggtcattttgatatggacgaggttcgttcctacctgcagcgattccatgatagttttaccttgttcgacccggagaggcccttcttccagacaccgggcttggagtatgtgaccgaaaaggaatacgaccccgtcagtgaaataatcgctgacgtacccaagccagacaaatacctattctctctaagggctaaaggcgctgtccacgacatttctctcgcggaggcggcccgctggctggttttcctggaatcctacgacacggctggaatcaagaccccggtcgcagggaatacccatgttaacaaaggcaaggtgtacccgcccaaaggcgcggttggaactggctggcttggagctatcggcggcgtttaccttgaaggccagaaccttttccagaccttgatgctcaattggtgcctgctcagcaccggcggcaggggcgacggccttccgttggccggcagagagaatgacaaacccctgtgggagtgctctcccgcagggcctgacatgcgtatgctcgatggggccgaggggccagcatcgctcttcacttggcaggatcgcaggatacggcttgtcccgaacgcggacctgagccgagtgcaaggcatggttatctgctatggtgacggtcttacggcagtcaataagcaggactttgagaccatgactgcttggagggaaaatgctaaacaaggcaagaagctagggctgtcccaggtaccgctgctgccccagacgcttgattccagcaaggcgctatggcgggggctggaaccgctgctgaagtttacgacagagatgggcagggatttgcgcccgggagtcgtggggtgggtcgagtctgtgcgggagctcatcgcttcgagcgcgaaccccctaacaaccgtggccattcacgctcagggcttatcgtacgggacgcaaaacagcgtttttgacgatgccattgatgatcgtgtcgatattcatgcctccctgctccgccatgacgcccctgccgtgtccacggtcctggaagtggtgcgagtgaccgatgaagctgtgtttgagctgtcaaaattcgttcattcggtggagcaatcggcgggagataagagcaaggacgctagggcgcgagccactagcgcggacgtcaaagaagaggcatacgacgaactggacccgctcttccgccgacgtatagcgaattttgaccctagccaggattatgcggcctacgggcaggagtggagggatgaggtgcacagaatcctgctggcgatcggcaggcagtatctctccgattccgctgctagcccctttgccttgcatgatgccggaatggcgaaacgcatctcagcgccgggcagtgaagccaagtacgcaaacgctttgaacaggctgctggggaagctgcatagcgtgcggtgatgctgtggataagtcgttgaaagatatgggaatggagggtattcatgggtgaaagctcaaccggcggaaaagcctggcaggtaggtttatacgccaatacgatcatacagaaactgcagggggaactcactgggaaaaatcctcgtgctaaggccaacgccagggcgtctcttgcgcgcttgcgcaagctaggcacgtctgcctactcgccgtggatggtaatcggcgatcaggtactcagtgattggcccgaggataagttgggcgttcccagtgaaggttcatacgcagttcgggctgtgacggcgactttgcgcttgtacgccctccaccagcagtcgcagtcctctcgaatggcggcgcagataaccgccgacgataatgaagagcggcagcagcagcgccgctccaccgcgttcggcgccgtctgccgaaagatcaacttggatttggactcatcccagggggtgcggaaacggctggacaatgtgtatgccgctagcgatttcgatggaatcgtaaagaatctatgcccgctgattgctctgattagggccagcaagcaatcggatagtgccaagcagatcgattactgtcagctggcgcaagacctctacttggtgcaattcgatgatgcccggcagtcggtcttcttccgctgggggcgggattacttctgtttccctcccagcgacaagaattcgtctcctcgctcgtccaagaaccaaactgcggaataactcgaagtaactgaagaaaaatcgtatacaaacactctaatgaaaggtgattgccatgttcgttgatttgtacgccctccaagctgtcccgccgagcaacatcaaccgtgatgacacgggtagccccaaaaccgcttattacggcggaaccctgcgttcccgggtctcaagccaggcctggaagaaggctatgcgaaaggagttcagggataccctgcctgcggataaagtcggttaccggacgaaaatggccgtgtcgctcattcagcaagcgataaacggcgcgcgccccgacctcgccgagcgatccgaggagctggcgacggccgtccttgaggtatcaggcctcaaagtcgaggcttccacccgtgctggagtgcagagcggcgctcctgagacccagtacctgattttcgtcggtgccaatgaagtggacggtcttgcgcaggtggctatcaactgggctgaccaggagcaggacttgaagaagccctccgcggccatgaagaaggaggtgctcgccgtattccatggggtaaaggcgcttgatatcgccctctttggccgcatgctggcggatatcccccagctcaacgaggatgcttccgcccaggtggctcacgccatttcggtagacaaagtggctcaagagtatgactacttcacggcagtcgatgaatgcgcgccagatgacaacgccggagccgcgatgattgacacggtcggtttcaattcctccacgctctaccgctatgcgacggtcaacattgactccttggtcaagcaactgggcgatcctgaagctgctgctcaaggcgtggtggcatttgctgaggccttcatccgctcaatgccgaccggtaagcaaaacagctttgcgaacaggacattgccctcgaccgtggtcatcgccctacgcgaccgtcagccaatcaacgtggtggatgccttccaagacgccatccgtcccgaggcaggggagtctgtggccaggaaggcagcccaagcccttggaagcaagctggcggatgtggagcaggcctacgatgctaagccggtcaaggcttggaacattgtgaccgataagcccgtcgaagagctcgacgcggtgagcgagcatgttgacctggcgcgcgcaacgactgagctgggcgaagccgttctcgcttctctaggaaaggggcaggagtgagtgtgctgctcctgcggctggcgggcccgatgcaggcatggggggactcctccagattcaccaggcgtaacacccgtaaggagcctacgaaaagcggtgtcataggcttgctcgctgcggcccagggccgttcccgcgaagatgatatagaggatctggtgcggctggagtacggcgtgcgggtagaccagcccggtcgcatcatccgcgactttcaaacggagcgcagtgaagactcgaaagccgtaatgccgttaagcaaccgttactacctgtccgatgcggtatttctcgtggctttgagcgccagtgaggaagtgctgctgtccctggacgcggccctgcgctcaccccggtggcctctgtacttgggtaggcgagcctgtcccgccagtttgcctatcactctcggggtccgtcaggagtacagcaacgtgcggcaggccctctccgctgagccgtggcaggctgattcctggtaccgtaagcgccatagcccacttcggctcagcgtggcatgcgacgcccaggagggtgagagtttcgaaagtcagtccgatcttcctctgactttcagcatagaaaaccgccgctacgccagcaggttggtccatcatttcgaggtggataatccaagcttgccgtcggtcccggagcaagttaccggtcccggggctttcggtgaggtcgacggtttcgatccgatgagtttttaggagcaggcatgtttatttccaggattcccctgaatacggccaggtatgagggccaccaactgctgtcttctccttataagctccattcggcagtggaacactgctttcccccggtgccggatgccggtagaagcgaaggcaggattctatggcgggtggatgtgtcgcaggagcgtaaggccgtatggctctacgtcgtcagtcccctgaagcctgacttcacgcacatcatcgagcaggccggttggccgctttaccacgagtgggagtgtaaggattactcgccattgcttaattcactgacccagggacagcactggcgtttccgcctgcgggccaatccggtccacaaggtaccgagtaagcccagggatggcgcgaaggatgccttggctgggagcattcaaggtcacgtaaccgtagctcagcaggagcagtggctgttgaaccgtgcgggaaagcatggtttccgcatactaactgaccacgaagtcccgcaggtggcggtcgcgcaacggcagaagcagcgcttcctgcggcaaggcaagactgtgacgctcaatacggcccaatttgatggcgttctggaagtgattgatgcaggggctttcagaagtgcattatgcaatgggattggcagagcgaaaggattcggctgtgggctgctgaccattagccaggtcctgcagcgggatacgaccaccgcatgagcaccaatgacgatgcgctgggcagccgagcggcagcaccggtattcggcgaggcagggcaagcctcgccgaatggggtggctgagggcatggttgagggcttaggtgacatgaacagcgaggacaaaggaaataccgggcaggttcggtcgcgggcgcgtgccaaatcctcggggactcctccgcctgaactcggtgagttggttcgagtcgaggacaggctgtctttcctttattttgagcattgcatcgtcaaaagggaggataacgccattacggtgtcggatagtgaggggaccatccacttgccggcggcgaacctcagcgtgcttatgctcggtcccggtactgacgtaacgcaccaggcgatgaccgtcatcggggagaacggcgccaccgtcatctgggtaggggagcgcggtgtgcgcatgtatgcttttggcaagccgctcacccactcttcgatactgttgcagaggcaggcctccttggtttccaacgtgcgctcccggttggctgtggctcggcgcatgtatcagatgcgtttcctcaacgaggatgtcagtcacttgaccatgcagcagttgcgtgggcgggaaggcgctcgtgttcgtcaggtgtacagacgatattctcaggagacgggagtcgagtgggataaacgcacctatgaccatgaggatttcgaccaggggagcgagatcaataaggctttatcggcagcgcatacttgcctgtatggcatagctcattcggtcatcgtcgcactcggctgctctccggggttgggattcgtgcatgtcggtcatgagcgttcattcgtgtacgacatcgcggatttatacaaggccgaattatcgataccggtcgccttcgagaccgctgcgcaaatgccggaggatatcggctctgcggtacgtcataatatgcgggacgctgtctacgacttgtcgcttatgtctcggatggctaaggacattaaggatttgctgggagaagaggctgagctgcccgatgctgacgcagaccatgtgggactgtgggacgataaggtcggggaagttgcagctgggaagtcttatgggaatgaatgagcgcgtaaggattgggctctgatggtcgttatcgttttgacggcatgtccggtcgggctccgaggcgatttgactcgctggcttttcgagatttcgccaggggtgtttgtggggcatgtttccgcccgtgtgcgagaccggttgtgggaaagagcgctgggcctggtaaagagcggaagggccattatggtctattctgcccgtaatgagcagcatcttgctttcaaagttcatcgggccgattggctaccggaggaccacgatggggtcgagctggtcaagcgcccattcggcagtgaaaaggcatcagtctccggcagtcaacagcacggttggagcaaggcaagcaaataccggaaagcgcgccgcttcagctaccattgaccgtcatcctcagtttttccccgcctcacctccactgaacaagtaaatgtaaaagccatcttctgcgatagctattgctgcaatactaacgattctcaagtgtgttccccgcatgcgcggggatgatcccagaacatgcgcgtgatgcgctggggcgacaacgtgttccccgcatgcgcggggatgatcccccggcgacacgctcagcggaatcgccgcaaaagtgttccccgcatgcgcggggatgatccccgacacacgtaacgccaatttgtcaaacacatgtgttccccgcatgcgcggggatgatcccgtgagattgctagcatctcgataagtcgctgagtgttccccgcatgcgcggggatgatcccggctccttcgcgtactcaatcttgacggccgggtgttccccgcatgcgcggggatgatcccgctttggccgtcctcttcaacgaagagtacgcgtgttccccgcatgcgcggggatgatcccgctttggctgtcctttttaatgaagaatacgcgtgttccccgcatgcgcggggatgatccttgagccactgggattgggattggcgaatgctggtgttccccgcatgcgcggggatgatccctacaaggaccccatcacacttggcatgatgcagtgttccccgcatgcgcggggatgatcccgaagaatatgcaaaggctgaccagcgaattatgtgttccccgcatgcgcggggatgatccctgtctaagattgtagtcagtcacttgctgctggtgttccccgcatgcgcggggatgatcccgccatccgcaatcaagcgtcgactgacttccagtgttccccgcatgcgcggggatgatcccattaccacccgccagggcgcccccggcggaaggtgttccccgcatgcgcggggatgatcccccagaccttgcgccacagtgcgcaactgcttagtgttccccgcatgcgcggggatgatcctcagtcattatcatcctccttgccagggtcggggtgttccccgcatgcgcggggatgatccctgatacttttgggcacatccatacacccataagtgttccccgcatgcgcggggatgatcccgtcactttcgacgtgatggctgatccgtatcagtgttccccgcatgcgcggggatgatccccccaatcttatacgcgtgggcgaggtactcacgtgttccccgcatgcgcggggatgatccctgattatgctgataatatcccgctagcaaacagtgttccccgcatgcgcggggatgatcccgaactccttcttgcaccacaaggaggcgatttgtgttccccgcatgcgcggggatgatccctacggcgtcggcggttccgggttcagcgtggggtgttccccgcatgcgcggggatgatccccagcccttgatggtggtgaggctggaactgaggtgttccccgcatgcgcggggatgatccctgacccggatgccgctgtggtccgacctcaatggtgttccccgcatgcgcggggatgatcccttggcaacatttggcagacatgaacaacatcagtgttccccgcatgcgcggggatgatcccctcacgccggccgaagcggaccggatcattgagtgttccccgcatgcgcggggatgatccccaaccccagtccatgtccgtgcccttggtcgcgtgttccccgcatgcgcggggatgatccctccgacggtgtgcaggcggtgggcgggttcgcgtgttccccgcatgcgcggggatgatcccggccccggcatatacgcgctcttctaccacgggtgttccccgcatgcgcggggatgatcccagaaaacatccccttccccctaacagctcaatgtgttccccgcatgcgcggggatgatcccccctcaagaccgtcgcccctcctcagacagaggtgttccccgcatgcgcggggatgatccccagggtcgccatccaccgtaactacagattcggtgttccccgcatgcgcggggatgatcctagacaaagacccgcagacaaaagaaaaccccagtgttccccgcatgcgcggggatgatcccatgattcggcaaaggggggagggcctgcctgtgtgttccccgcatgcgcggggatgatcccaagcgaattgggcacccatttagctagtgtccgtgttccccgcatgcgcggggatgatcccttgtgtctcagattatggagaccccccgtacagtgttccccgcatgcgcggggatgatcccgttggtactttgcgtaagtatggtcttacgatgtgttccccgcatgcgcggggatgatcccaccaacgacttaaccgggtaggccaaggaatcgtgttccccgcatgcgcggggatgatcccctgaccgccacatggtcatacgaaggaggccagtgttccccgcatgcgcggggatgatcccgccggtggatacgggtcatcaaacgggaagtggtgttccccgcatgcgcggggatgatcccgtcgacacatacaataatctacacaaagattagtgttccccgcatgcgcggggatgatcccaccggcataggtgatggtaccatacagcagaggtgttccccgcatgcgcggggatgatcccggtaagattaataattatcttaatccaacaaagtgttccccgcatgcgcggggatgatccccttaaaaaattatcccctgaactgaacgacaggtgttccccgcatgcgcggggatgatccccgtcaagctgacgggtgggcactccacgacaggtgttccccgcatgcgcggggatgatccctagcgccggaggctttggctgtctgagcatcggtgttccccgcatgcgcggggatgatccccctgacccgtcggtctgcgagtcgtcaaggccgtgttccccgcatgcgcggggatgatccccggcgaggtggatagtttcgacgccaagcgatgtgttccccgcatgcgcggggatgatcccttcagcgaatcgcgcaattcgactagcttattgtgttccccgcatgcgcggggatgatccacgccgtgttcccattcctcaaactggaggcattgtgttccccgcatgcgcggggatgatcccttacgttcactgtcccggacccgcttgagccagtgttccccgcatgcgcggggatgatcccgagttgcgactcaacgaggggtttgaacagacgtgttccccgcatgcgcggggatgatcccatcactttcacattgaaggaaatgattgactcgtgttccccgcatgcgcggggatgatcccgtgaacctgaccgtgaccagccggtccgtggcgtgttccccgcatgcgcggggatgatccccgaaaagccccttttgaagctccgcttgtttggtgttccccgcatgcgtggggatgatcccggcgtgacatcgggcatggtgtcgggcatgatgtgttccccgcatgcgcggggatgatcccgcaatcaaggattcggctggcccggtgctggagtgttccccgcatgcgcggggatgatcccgcagacagccagtcaccggcctgtttgacaacgtgttccccgcatgcgcggggatgatccccccggtagcgtggcgtggccatgacggtcaccgtgttccccgcatgcgcggggatgatcccgccgaccaggcatggcatgcaggcaccatgacgtattccccgcatgcgcggggatgatcccccgaaagtcatcctgcaaccgtccattaacgagtgttccccgcatgcgcggggatgatcccttctcaagatggatgctgggcgtcatgtccgggtgctccccgcatgcgcggggatgatcccaacgtgaagggcatttccgacgcggccaaacagtgttccccgcatgcgcggggatgatccccgccaccagcgcacaacgccacgacggcaatagtgttccccgcatgcgcggggatgatccctgttcggccagctcacctcgctgcgccccttcgtgttccccgcatgcgcggggatgatccctatatatagaagctacatctagtggcgctcaagtgttccccgcatgcgcggggatgatccctgcgccgtgaaccggtcgccggcgggaccaccgtgttccccgcatgcgcggggatgatcccaggtcgttatcgcccagaaggtcaggattcttgtgttccccgcatgcgcggggatgatcccccgttagaactcatggtattgctcctcgtatcgtgttccccgcatgcgcggggatgatccccaagctggacgccgcaaaaaaggtaaggaaaagtgttccccgcatgcgcggggatgatccccgacggcaaagggtcgggcaggtctccgttcggtgttccccgcatgcgcggggatgatccccagccacaatccggccgtgatgcgtgcgccgtgtgttccccgcatgcgcggggatgatcccccgtcccgaactatctgctggaccgggattacgtgttccccgcatgcgcggggatgatcccgcccgcgcacgcgaagtcggggccctcctaaagtgttccccgcatgcgcggggatgatccctgctgcgcgtcatccaggttagccatgttagggtgttccccccatgcgcggggatgatcccgcctggttggtgtccaaccggtcccggtcctggtgttccccccatgcgcggggatgatccccagtgagcccgtcgggcgtcacgaaccggccggtgttccccgcatgcgcggggatgatcccgccgcataggtcgcgtaggccgaaccgtagacgtgttccccgcatgcgcggggacgatccctaccccctacccctcagaatcgttggaattccgtgttccccgcatgcgtggggatgatcccaaattggaggaacaaatggctgatgtgaccaagtgttccccgcatgcgcggggatgatccgactttccgcctcctcgtgcacctcgtcccagcgtgttccccgcatgcgcggggatgactcattcctggatgactcaaagcgaatatgtagggtctaccggaggagttgctccgcgtacggctggatgacctcatattccgggtccttcgccagattctcgaccccctgcgggaacctggcgtacagctcgggatgatcgacggcgatatcaagggcgtcggcgatggccaggtcgggctcgccggcgaaaatggcttctcttgcaagttcctcgcaatcttcgtctaacccggctaccaccttgagggactgctcagccagatccgtgagctggtcaaacgtatagttcacttcccgcctccctgtctccgaagctcgtcacggttgactcccgtgggggattctaccgtttttcgcgtttctgattacgcctgtgccttcgggcgggtatgttcggtcaatgtagtattcccgcctgcatggggatgattctttgattcgacagttgcggtacacagacgtttcgtgccctccccctccctgtgcgttcggggatgatcccagcggcttgggcagggacggcgtgctgtcagggtgctctcctgcgtgtgcgggatgatcgcccttttggaaacccggtcacccgccttatctgcgtttccgacgatgaggggggtgatctcagccaccttgtaagattatgaagcgctcggcagtgttccccatccgcatgggggtgaccccagctttagtgttattgtcgagtttgaagaccagtgttccccgcttatgcggggatatcgccaacctgacgctcaaagatgaacgatagttaagtgttcgaagtccatgcaggcatggctcctatcgctcatgaaaatcgcgtgcgatatcatcattttccttgcgcgcgcgggatgattctgtaccgatgccatgtcccccgcaaggcacgtattcgtgtctcctgtacggaagagaaaatcaatgcgccattaaaggaaccagccgccgaccgtgacctgtgcaaggaggaaggggccagttgacgtgaaacacatataagattgttgacaacgaattcatcggggtacggcaacgggaacgtcgcaacttgcaccgccgctacgccattgatgccttacatccattgcaggggaacaggggggcatggcaacggacgcgcaagccgaaacggcataccggaagctaggaccataccttgcgtcagtcctaggcgccgatattctctccagcctggacgctggcatagccgacggggaaccctacgaagccctcggatggctgctctcctcaatcaatcggccaggcgtctccgtaaccaaggacctgtttctgcaagctcgcgattgtctgagcgatgaggacaaagaagaatacgggcacctgctgcgctcgcagcatgtagtcgcctgaaagcgcaccatttgccaaagacgttggacgcccaggagcttttgcgcatcccaatggctcatggttttcgctgattcttcgcgtcgctgtgttccctgcacgtgcagggaagattcctgatacgcgctgatgaaacgcatggcacccggaagagaaccgggatgattgccgtcttgcctcagttccctgtgttcgcaccaatcgatacggtcttcttggtcgcgctgttcttcgttaatcaaaggatgaacagggataaagatatcgaaggggcgtgttgacgcggaccttggtgaggtgggccaccagcctgcaatgcgtggcccacctcaccaaggattttcggcggagcccctggccaccggttgagctatcacgacagtcccggtgacgtttgacgccatgttcacatcgcaaacgtgtatcagtcgtgatggtcttgcgtgttcagatgcggcggtgggcgagtggccgtagagtcagtggggtttgccaacaaccgttggatagctcatcaaggagggccaccatctccgcttcatcgactcagcaatcccctcgccccgcaggttccgcgctgcgcccctggctcatcttcctgggttgttgcttgctttcgttcgtgggatacggtctgatagttaacactcccggactctattacaaggcgctgtcctcggacctgggagtttcacgcacacaaatcgcgctcacttccaccatcatgaacctgaccggcgcggcgacgatgttgttctccggcaagcttatgaagcgcgtggattcgcgcttgctgctcagcgtgtgcatcggggtgtgcgccatcatcttcttctgccagtccttcttcaccagtctctggcagttctacgtttccttcgcgctcatcggcgtcgcgtatgtcatccctatcaccttggcgccttcggtcctgctttccaactggttcgagcagcagctgggcctggtgatgggcgttgccttggggctttccggtttgggcggcatggtcttcaatcctgtggtctcctcctggatcgccaatctgggttggcgtccggcttaccggatgaccgctttgctgctggccgtatgcatcctccccttctctatctttgtgctgcgtttcatgcccaaccccgctaaaggcgagaccatgtacgaagccagcccggcgtccgctgaggccgacgccggctccaacgccccgaaaggtgagcttcaggatccatcttccatccccgggatcgaggccaagaaggcataccgcacgccgaccttcatgcttctgattgcttgctatgtcctccttcaatgggccacggggatggtccagcatgtctctggctacgagcaatcccgaggcctgaccctgcaggagggggccttcgcggtctccggcatcatgctgggcgccgcaattggcaaggccacgatcggcattcttctggacaggctgaagaccgagctggtcctggccttgtactcggtggttgggctggcaggttgggccctgatgatgttcctggtcacacccaccccggcggcgatctccggcttcctggctggcttgggccagggcgtcctgctcgtggccctgccttggcttgcccgccagtccttcggccagcgggactacgccgagattttgagcatcctgaccatgtccggtgtgctttcggtcgctttggcgaacacgatcaatggcacgatcttcgaccttgccggctcctacatcccggccctggcgatcaacgtgatttgctatgtcctcgcgctcgccgccgccatcgccgcctaccgcctgcgccccttgcgcgaataagcaagcgcgtcgctgccaggccgggccatgttccgagcggtgattcggcgacgctcccgtacgatgcctggctactggtgtatactggatgtttggcgtgattcgcccgcggattgagagcgcttcagcatagggctggtgcaccgcgcaacggatgcaaggagagaccgtggcactgacggcggaagacaagaacaagatcatcgctgagtacgcgacccacgaaggcgacacgggttccccggaggtccaggtcgccctgctgagcaagcgcatctccgacctgaccgagcacctgaagacccaccagcacgaccaccactcccgtcgcggcctgctgctgatggtcggtcaccgtcgccgcctgctcgactacctgaagaaggttgacattgagcggtaccgctctctgatcgagcgccttggactgcgccattaagtgaacttccgcccgggccttgcgctcgggcgcttttgcatgccgatagttgaacagcgaaacagcgaaacagcgaaacagcggtgagcgctgaggactgatgccggggaagggcgtggaagcgccgggcccgggtcccaagcgcggatgcgacgccgcaggtatgaagaaccgggaaagatgcgcgatcaggtatatcgcgtccggcatgcacgaggatgaatgaagtaggacagataaacagtagtaacaaaaggaggaacccctatggagggtcccgaaatccaggctgcagaagccacgattgacaatggaacattcggcaagcgcacggtgcgcttcgagacgggtcgtctcgcccagcaggcggatggggcagtagccgcttaccttgatgatgacacgatggtcctgtcgaccaccaccgcagggtccagccccaaggagaattacgacttcttcccgatgaccgtcgatgtggaggagaagatgtacgctgcgggtaagattcccggctccttcttccgccgcgaaggccggccctcgaccgaggccatcctggcctgccggttgatcgaccgccccctgcgccccctcttccctcacaccttccgcaacgaggtgcaggtggtcgagaccgtcctggccgttgacccggatgacgcttacgatgtgctggccttgaacgcggcctccgcctccaccttgatctccggcctgcccttcgagggcccggtctccggcctgcgcctggcgttggtcgacggtcagtgggtggctttcccccgctggtccgagcgtgagcgcgccgtcttcgagttggtcgtagcgggccgcgtggtcgaaggcggcgatgtcgccatcgccatgatcgaggcgggcgccgggaagaacgcctgggagctgatttacgacgaggggcagatcaagcctgatgaggccgttgtggccgaaggccttgaggcagccaagcccttcatcaaggtcctctgccaggcccagaacgaactgaaggcccaggccgccaagcccaccaaggagttccagctcttccccgagtacacggacgagctgtacgcgcgcatcgaccagatcgcgcactccgacctggatgaggccctctccatcgcggagaagctccctcggcaggagcgcatccacgagatcaaagagcgggtgcgtgagcagctggctgatgagttctccgacatggaggagaacgaaaaggagaaggagctgggcaacgccttcaaggagctccaacgccagatcgtccgccgccgcatcctgacccaggactaccgcatcgacggccgtggcctgcgcgacatccgcaccctgtccgctgaggtggacgtggtgccccgcgtacacggctccgccctcttccagcgcggcgagacccagatcctgggtgtcaccaccctgaacatgctcaagatggagcagacggtcgacgccctctccggcccgaccacccgccgctacatgcacaactacgagatgccgcccttctccacaggtgagacgggccgcataggttcccccaagcgccgtgaggtcggccacgggaacctggctgagcgtgcgctgattccagtcctgccctcccgcgaggaattcccctacgccatccgtcaggtctctgaggccctggggtccaacggctccacttcgatgggctcggtctgcgcttcgacgctctccttgctggctgccggcgtgccgatcaaggccccggtcgcaggcatcgccatgggcctggtcaccggcgaggtcgatggtcgccccacttacaagaccctgaccgatatcctgggcgccgaggatgccttcggcgacatggacttcaaggtggcaggcacctctgagttcatcacctccctacagctggacaccaagctggacggcatccccgcggacatccttgcgggcgcccttcagcaggccaaggaggcccgcaccaccatcctcgacgtgatcaacgagtgcatcgacggccccgccgagatgagcccgttcgcgccgcggatcatcaccaccaaggtgcccgtcgacaagatcggcgcggtcatcggccccaagggcaagatgatcaaccagattcaggaggacaccggcgccgaggtctcgattgaggatgacggcactgtgtacatcgcctccgagggcggcgaggctgcacggaaggccaaggagacgattgagcaaatcgtcaacccccacctgcccgaagctggcgagacttacaacggcaaggtcgtcaagaccacaagcttcggcgctttcgtcaatctgacccccggcaccgacggtctgctgcacatctcgcagattcgcaacctggccaacggtgagcgtattgacgcggtggaagacgtgctccaggagggtgacgaggttcaggtcatcgttcaaggcgtggacgaccggggcaagatctccctggccatccccggcttcgaggacggggaatccggttctcgcgggcgcgagcggggcgagcgtgacgagcgttccgaccggcgagaccgcgaccgtggcggccgctatgaccggcgcgaccatgaccgcgaccgcgatcgtgagcgcagtcattcacgccgggccgagcgtcccatcttcgaggatgacgctcccgttgattcggagtacgacttcgaggagacggagaaggtctctcgtccacgccaccgtcgcgaggaccacgattacgaccgcggcgagcgtggcggccatgagcgctctgagcgttcgggtcggcgtgaccgcgaccgtggcggccgttcggaccgtcgtgaccgcagtgagcgctctgagcggggcgagcgttccgatcgcggcgagcgttccgagcgtcgccacgagcgttccggtggtcgcggaggctaccgtgggcgtcgtgagaacccgcgttacgcggccgatgagcattacgacgagtacgaggctggtcgcgaggagcggaccgagcgtccccgtcggcgtgtgcgcagggatttcgacccctttgatgatgagggctgatcgtcggttgacgctggcgtgaccttctagcgtaagcggccctggccttctggccagggccgcttttcgcgtctttggggctagcggactgatatggaataataaagctatgtctactcttacaataattctgatcgtgcttctggtgctgatcgtcctcgtggtcctgtgggccatcagcgcttacaactccctcgtgggcttacgcaaccgggtcaagaacggttggtcgcagatcgacgtggtgctcaaacagcgttcggatctggtgcctaacctggtcgagaccgtcaaggggtacgccggccatgagtcaggcactttaaccgccgtcacccaagcccgggccggaacggttcaggcggcggcctccgcccaggacgattcgcgttccgtggccacgcgcgcccaggccgagagcaggctctccagcgccctgttcaacctgatggccaccgctgaggcctacccggatctcaaggccaaccagaacttcctggacttgcaaagccagctgtccgccctggagcagaagatcgcttacgcccgtcagttctacaatgacgtgacccaaaagtacgacacacgcatccaacaggtgcccagcaatatcatcgcttccctcttccacttccaggaggcccagtacttcgaggccgagcccgaagccagacaggttccgaaggtggacttcagcaagtgattcagtcgggttcggccgcttcggccgaagtggggtggcgcctaatcgcgccggatggaggcgacagtgggccaagcggaacaggatcagacccctttggacgatgcgttcaacgtgcctggtgagcctagcgcgctcaccgaacctagcgatggcaaggcttcggcccctgacattaattatggcgctgattcagcgcaggataccggcgctgcaggccctacgggggacgctggaccggctccggaaggcaaaaggggctcgcgcgccctgtcttgggatgtcaagcgtttcatccgctccctgctgatcgcgcttgcgacggtcttgatccttgccggcctgttctccgctttctccactcacctgcccgacctgtcctacaacgccgttgattacgatgtgacggtcctgcccaatggcgatttgaaaatcaaggaacgcatcgacatgaagatgctgagcagggagggtaatacgccttggcgccagctctaccaacgctacaacatcaaccccggcaatttgactggcatatccgacatttccctgtatgacgtggaccaggacctgaactaccggcagacggagccaatcgacccggaccaagtgcagaagaagagcgcgaggagttgggacctggaggaagcgaacagatggtacataggccaggtggacggggaaagcatcaaggactaccagtaccggcagcccctcaacggggtcgaccctacgggcgactcctgccagaccggcggcagctcctgccaggtcgagataggctggaacatcttcgatctcaccgatgctgatagcaaggtcttcgagttgacgatgaccatgcacggtgtgtccacggcctacgacgacgtgaccgccttccagtgggagccgatcgggcagattaacgagattccggtaggcaaggtcaccggtgtcgttcatctgcccaagggcgccagcggatccaactccaaggcgtggctccactacacgggcccctcgcgaaactggcggggcgcggacggcagtgtgcacttcgaggcttcgcaggtttcgcccgggcagtacttggatttgagggtcacgatggaccggtccctgaccggggatgtgcctcggaccggccagggccgggccggccagcgcatcgctgacgaggaggacaaccaggagcggcagtggcatcagaggcaagtccttaaggcccgcctgatcctggcggcctgggccttggccgcgatcctagtcctgggtctgtgcgtcctggccatccgtgcggccttctccagcttccggcgcacccgctacagcggacccatcctctactggcgccaggccccggacatgtcgcctgccgcggcggccgccctggactgcaccatcaacggggataagaagaaggccctgcgctcgcggcaaatggcttcgacggtgctctccttggccgctaaggaggtgatctcaatctaccctggaccggtcaaaacctatgcgggcatggacatgctccaggcgagcgagcgtgacctggctcaggccgcgagctccagcgtgagccatctgcaccgctcagagcgcacttccacgatcgtgatcaggccggtggcctatggcgatacaaacgtcctgggcttgtccgcctcccagcaagccgccttggccatgctcaagcatgcaggcgagagtctgaactcccgcgttttcgaccttaagcagatgggggagtcttacaaagaggacgacgatgggggcaaactcctggaggctttcgacgatgcggcggccgccgagttcggttccctggccgccacgactgagaacggaattaatgggatcttggaagtgcttggcatggtcgcgggcatcggcctatgggccttggccaagatgagcgggcagatcctcctagggggggtctgcggagccgtgctcatcacggtttgcgctttcgcgcgctcctacggcgcgtccacggtgctcagtgacgaaggccagtcctgggctggtcggatttgcggcctgcgcaactacctgttggactactcctccttctcggaccgcggcgtcgaatacctgccgttgtgggaggactacctggtttatgcgacggccttgggcattagcaaggaagccatgcggcagttggccttggcggttcctcaggtaactgacgccagctggctggacaactatgcgagtggtctggtctactggtcctaccgaccttacgagttcggtggctcctggttcggcgaggggggcgttgccgctgtctcaggcctccccggcttctctgatttctccgatttgggcaatcagctgactggtgggttctcgcagatccagtcgacgatctccgctgcctccggttcatccgggtcgggcggtttcggtggtttttcgggcggttccggcggtggctccttcggtggccgctagcgcttcgcccgcaggtcccgtaggcttaaaggggcggggcgcggcagggcccgcccagcggtctgtcacgacgcttgtgcgggctgcttgccgcaagcttgaaggaaaggaagcaatcatgacgctgttgacgaggacgttggggtcccaccagaccacagccgttggtctgggctgcatgggcctgtcgatcgagggcaagcctgagcgtgggcaggctgtcgaaaccatccacgccgccctggacgcaggctgccggcacttggacaccgcctggtcctactacgaatccggtggccccgagcagaccaacgagaatctggtcagggaggctctggcttcttggaagggcccgcgcgacgaggtcctggtagccacgaaggtggggcactaccgcaatttcgaggacggcgagccatcctggggggtggacggccgaccggagaacctgattcggcgggccaaggagtcggctatggcattgggcgtcgatgcgatcgacctgctttacttgcaccggcccgaccccgaggtcccctaccaggagtcgattcaagccatggcccaactggttcaggagggcgtggccaaggaggtgggcatctccaacgcttccattgaacagattgacctggcccgcggcatcctgggccaaaccctggtggcggtgcagaaccagttctcgcctattttcctgagttcgcgccaggagctcaagcacacccagcaggtgggcctggctttcgtggcatggagccccttgggcggcttccgcaagcctaaggatgaggctaagttcgaccccttccgccagctggctgaggagcgcggggtctcctaccaacaggtggtcctcgcctgggagctggcccagggcgatcacgtgttcgtcctgcctggagcccacaggccccagaccatcctggactccctgggagccggtcaactggagctcacccgcgaggaactgggaaggctaggctgagcgcgcatggagcgattccggcaagctcaacacccagggtccgcagaggccagtgagccgacgttcaagcagtggtccggccagcatgagctggtggacagctcggcttcgccctggcgtgagccttccggggcgccggtcccggtgacggttccggtggacttggcaccgggcgtgagcgtggcctacaccacccgcctgggcggggtcagccagggcgattacgcttcgcttaacctgggcggcaagggcgacgacccagcggctgtgacctccaaccgcgaagccctaggcagggccctgggcgcccagctggtgctcgtcagccaggttcactccggccgggcggtggacgctgatgccctgcttgcggaccagttgaaggatgtggaggccgatggcctggtttcagcccaaacaggcttggccctgggtgtgttcgcggctgattgcctgccggtcctcctggccgatccggaagccggggtcattggggccgctcactgcgggcgcaagggcttggagcgaggcatcatcggcgccaccgtggatttgatggaggccaagggagcccggcgcggctccatcagcgcgaccttgggcccagccatctgcggtgactgctacgagttgggtgaggggatttccgatgccttcggtcggcgcttcccaggcgctaccaccagcacaagcttcggcgggccaggtgtggacatcagcgcggccgccctccaggatctccagaccgcaggcgtgacgcgggtggtggactccttgccgcggatcgccgcagcaagccgatacctgcgggaggaccaggagttggccgacttgtgcgcggacgatggccaggggcccgccctcacccaacgcatggctgacttgcgccaccctcgctgcaccctggagaacccgctgtggtactcccaccggcgttcgagcctcgccgaaaggcagggggagggcaggatgctggccctggtcacccgccaagggtgagcccccgcaggccgctggggcgagcctcgggttagactggccttatggatcagcttaagatcatcatctccggctatgaccgctacgaaggcgtcgaggtcaacccttcctgcgaggtgccgcaggccatcgccgagcagggggtgccggccctggagggcgaggatccgctagagggtgtggacttggacattcggcaggtctcgctgccggtctctttcgggcaggcgtggcccatcctgcaccaggccgtcgaggaattccagcccaggatcatcatcgccaccggcctgaaacgttcggccaggggtattgccatggagcgttgcgcggtcaacctcaaggatgtcggccaggcggcggactcctccgaggcgcgcccggccagccagcgtgaacctatagacgccgacgggccagcggcctactggactcgcttgcccttgcgcgccatcctccacattttcgcccgggacaacatcgccgccaccctgagttcggacgccggcacctacgtgtgcaacgcggtcttctacaatctcctgcactggacggccaaccatcccggcgtcctggcagggttcgtaagtctgcccccggtttcccaagccggggcggggaaggccccgggtctgcccttggacctccagattgaggcagggcgcgatgtggtgcgcgagtcggtgcgctattaccggagcccgtcctccggcgatatgttgctggcgtgagccggcccactggaggcgcctggcgcgtagaccttgcggacggcgcttattataaggcttttctgagcgtacctgtagggtagaatgacattcagataattattgtaggacgcgggcccgccgggtgacacgggagaccataggtgtggcggcaaagaggagtgaagcatggcggacgaacagtttcctatcgtgttgcgtgggtatgacaaagataaggtcgacgaagccctcgccgccttgcaggacaacctgtcccgtctcaggcagcagattaagagcgacgacagcaggattctgaaacttgaggcccaacttcaggaggagcgttccaagcattcggccccagaccgtgaaggctccttcgcctccctgggcgccaacgcccagcagctcctggcctcggccgagcagacatcgaccgagctgctggagcgggccaagcaggacgcggccgctaccaggacttcggcccaagagaaagccaacaccctggtcaaggacgcgcgcctggacgcgcagcgcatcgtggacgaggccaaggccaaggcggcttcgatgatcgagactgcggacgaccagtctcgcaccctgaccacaaccgcccgccaacaggccgaccaggtcaagctgtccgctcaaaagcaggcgcaggagcagcgtgaggccctgcaaatggagctgaagaacactcgcgaagaggcgagcaagcagctggccgccgagcgcgcggcccaagagagcaagctgtcccagtcgaccgcggatgccacgaggcagatcgccgagcagcgccagaaggccaacgaagaggtggtcaagctcaagaagagcgccaatgaccagattcaacaagccctggccgaggccaacaagaagctctcggatgtgcgcgagcaggtctccaagatgctgacggaagcccagcgccaggccggtgagatcacggacaaggccaagacccaggctcagaagatcgttgacgatgcgaatgtatcctccgcggacaccaaggcccaggtcaacgccgaggccgaacgggtccgtcagcagatctccgcccagcaggaggagaccaccgccaaggtcgatgacctgctgaagaagctggatgagcgtcgtcgcaagaccgaggaggagaccacccagctgattgagcaggcccggcaggcccgcaaggacgccgatgccttctccgcatccaaacgtcaggaggccgagaccaaggcggctcagatcctccaggagggccacgaacaggccaaggcggagattgaggagcggcgcgcggctgcgcagaaggagttgagcggtcttaaggaccaaatcgccaagctccagcaccgggaggccacgatcaccgcccgtgtggacgatttgcgctccatcttctccaaatcctttggcgctttcgaccagctcggcgccatgcccgccgcttcgcaggccggcccggccacggacctgggcgaggaggaagcctcctcccaacaggttccggccctgccgtcggtcgtaaccgtccctcgtccgtccgcttcagaaaccagcggcaaccacagcgaccaaggcggtccggcggcttccaagcaggccgtaccagcgcccgctccacgcccttccaccccattgcccccccgggaaggccagggccatacgccggaggccggggcatctcagtccgcccccacccaggtcctccagcgcagccaaagggagtcctgagccgagcggcacagcactcagggagcccacaaaggcgccctcacacgggcagggtcatctcgtgctctcacgaggcgcgatacgatgtcttgagcccggatagcaattccaaatagcacagaggaaaacgaagatatgaccacagatttgacacccttatccgcatcggccctggagggcctgcgcaccgagtttgaccagcgcgctgacaaccgactggccatgaatgcggtcacctcctcgggcatcgcccccgtggcccataattacgaccgcgcccggctcctccagcaccgcttctcggtgaccgtcgacaacggcaaggtcaccactcaggcccactcaggacgctgctggcttttcagctccctgaacgtggctcgtttcgtggcccgtcgcgccctgaacatcgacaccgcctcgacctccaacccgtccggcgatttcgagctctcccaggcttacgccatgtactacgacaagctggaacgttccaactacttcctgaacgacgccgccaacctggtccgcgccggcgagaagaccgactcccagctcatgcagttcctcctgtccgatgtgatgggcgacggcggccagtggatcatggccatgaacctgtacaagaagtacggcgcggtccccaagcagtactacccggagaccgcctcctcgcagaacactggcccgatgaacacccagctgcgctccgtcctgcaccaggccgtggcgcacatggccgccgacccagcctcgatcgaccagatcgtcaaggattccttggccgcctgccaccgcatcctgaccatccatctgggcactcctcccacctccttcgactgggagtggaccgacaaggacggcaacttccaccgcgacgggcgcatcaccccgcaggagttctggaagaagtacatcaacgctggcctggaggactacgtctgcctggtcgacgacccgcgttccgagcaccccaagggtaagaagatcggcatcgagcacctgggcaacgtagcgggcggcgacgctaccgagtacctgaacgtgcccaaccagttcatgaaggactgcgcccgcaccatcctgagcgagcaggggctgccggtgtggttcggcgccgactgtggtccaatgatggaccgcgacggcgggcagtgggccaccgacctgttcgagtacgggcgggtctacggtttcgacttcgacatggacaaggaacagcgtgtccgcttcggcgactccgccatgaaccacgccatggccttcgtgggcgtggatgtggccgatgacggcaagaccaccaaccgctggcgggtggagaactcctggggcgacaagatcgccaacgacggttacttcgccatgagcgacgactggttcaccgagtacgtcttcgaggtggctgtgcccaagtccatgctccccgctgagtaccagaaggccttcgaggagccggccatcatgctgccggcctgggatcccatgggcaccctggcctgagcctctacgccggcctatgaggccgtgaacgccagcgacgtccgctgactccagctggggtcagcggacgttcgtcatgagtggggtgactcctggtccgctgagcaggccttggcctaggatgggtgtcgccggcagggcgtcaactccccggcgtgaaccggatgattcagtcaggagcaaccatgcagagcgcaacccagtcagtcaccaccgtcggcaaccaggatctcgtggccgtgctcggcgcgatggacgaggaggtggccctggtagcccagggcttggatggcgtcgtccacgaccccgcctcccggtccgctggcctggatgtggtgcgcgggcgtctgccgaaggcggacggtgggcacgtggagcttgcggctacggtcggtggcatgggcacggtcaacatcgccgcctcggcccagtacttgattgacgcctaccatcccaaggccctgattttctccgggatcgccggcagtctgaacaagtccctccacatcaacgatgtggtcctaggcggcaccttgcgctacctggactctgacatgcgcatgatcgcccagttcgcccccaagaccgaagtcttccactccgacccctacctgctccaactggccgaccaagccctggacgacatgggcgtcacgcacatcaccggcacgatcgccactggcaattatttcgtcgatacgcccgagaaaacggccgaggtcaaggcccagacaggagccgacgcggtcgagatggagggggcagcggtctgccatgtggccgcccgcaacggtgtgcccgcgctggtcatacgcgccctgagcgacaacgccgacaccgactatgaggtcttcaaggagtttgacatctccgagtacgcggacaccgccgccaagctggtcctgagcatcgccgcccgcgtctgaggccgtgcgcgacctcgttgtcgcgcaaggtcgtggcttggtgtatactgaagcgttgtaaaccacagactgttggttgggggtcgcaaggcctcccgaagttcggttcactgagccagcacaggttgagataagcagtaggctacggtctgctgccgctgaaatcttcggattttgtatgctctgcctgtgcgcagggcttttttattgcctgctggtaaggggttccgggcgggtccttcggtcgattcagggaaggaacgccatgaaaaggcccgaaaaggaaaaggtggtcgccgagttcacggacaagttccgtgaggcggacgcggtcatcctcaccgagtaccgcgggctcaccgttccgcagatctccgacctgcgggacaagctaggccgcgagtcttcctatgctgtgaccaagaacaccctggcccgcattgcggccaaggaggcgggcatcgagggtctggacgaccttatctccggtccttgcgccgtcgctttcgtcaagggcgattacgttgaggccgccaagaccctgcgtgacttcgccgcggacaataagcagctcgtcgtcaagggcggtttcatcgatggggccgtcgtcgacgccgaagagatgcagaaaatcgcgagcctcgagtctcgcgaggtcctgctctccaagatggctggcgccctcaagggcaccatgtccaaggccgcttacgccttcgtcgcgctgcctacaaaggctgtgcgcacgatcgacgccctgcgcgagaagcaagagaaggcagcctgaatcccaggcccctggccgcgcgattcagacgcataggaagcaaaaccgaataaagttgtacggccgccgctcgcgcctgcgaaggcagccatgattgaaaggaagccataatggctaagctctctgctgatgagctccttgacgcgttcaaggaaatgaccctggttgagctctctgacttcgtcaagaagttcgaggaggagttcgacgtcgaggccgccgctccggtcgccgccgtcgctgccgcccccggtgccgccgctccggccgccgaggagcagaccgagttcgacgtggtcctctccgccgttggcgacaagaagatccaggtcatcaaggctgtccgcgccatcaccaagctcggtctggctgaggccaaggccctggtggacggcgcccccaagcccgtcctggagggtgcctccaaggaagacgccgagtccgccaagtcccagctcgaagaggctggcgccaccgtcgagctcaagtagctcctggccgcttcttacagcgaagaaaccccgcccctggtcctccaggcgcggggtttcgcttatagtggcgcgccgatatggggctcaggaacagcaatgctgacgggtgcggctgacttcgcttgcgtccggctctgaccggggcctgcgccgattcgaccctgcttgtggatttatgggtgccgcctggcgtatacgcagccgtgatttcgtctccctatcgcatattcccgttattctcgctggctcgcgccgcagcgctctggtggcggggttgggcgttggaactcataggaggcggccctgcgctggggttgggggagtagggctccggggccgcgccccaaggagcgcgtacggtagttgggtggggtaatatagggctgtaaagctgcctacgggtggtcgtcgtgtggagctataagggcgattcgagcggtgccgcctccgaatttcagggattcatggcacaatagtaggtagtgtaataaatacgcatgcgtattttgctttgggaaaacgggaggtcgagcacggtgagcgacggtcaacggccgatacggcaatgggcggtcactatcaacggcgtagagaaaatccgcctgagcccagggcagagcatcgagattgggcgcaagcccctgcgccccctgccggatgacggcatggtccgcttggaggttcaggataagactaagtccatgtccaagcgccacgcctcattcatggtgggcgatgatgggagcgccagcctgcgcgacctggggtccacgaatggctcctacgtcgtccaggatgacggtgacctgattcgcgtgccggaggacagcgactacacccttcagcattcggcggagcgcttccagttcggcgacgtgctggttgacttcgcgcagatcgccgatcccgcgcccgagcagcaggaggaggggcaggccccggccggctcccaggtgcccgatcttttctcttacgctcaggatgagagccgcaacagccagatgcctgacgaatcgaacctgtcggtggacgacatccttgacctgcgcgcgggcgagcccaccggcattttccaggcggagggagcgcgctcccggattgacgccctgcacgatcaggcggtcagtcagcgccagcagcctgcccaggagcaggggcatcaggcccagccggtccaggcccaacctgaagaggcgcctgtcgaggagagcgagcctgagtcccggtatgtggacgcctccgcacaggccgagccagccgaaagcgatgagctgcgcttccagcctttgggcgcggcccagttgaaccaggagcgccaggagcgcgagagtcaggcggccgaccagcagcaggccgcggccgcggacgggaccgaggaaggtcaggcttataagcccgctttcgagcctggttccgtcttcgaaaaagtctccaggggcgacttcccccaggatgatcaggtcgttgaagtcgatgggatgaccagcgacgatgctaagaactccactgatttctccttgcagttcgagatggcgaagcacactcagctgctgcctttcctggccatgaatccttccttgtacgacgacctgtacgcatggttgtcggcgcaaggtgacgaagacattgacgcggcgctggagaagaacgagggataccgcgagtatctagcagcgacgcaggagtgagcgaggatgagcgaacggtcatcgaagcatgacgatgaggggctgcgcgaccagcccacgcctgctcagaccgatgaagtcgcagcggctgccgaggcagacgctcaagaatccgagcaagccgggggtgatgagcagagctcagctgacgcgctgaaccccctggaccgcatccgaggctggcggcaggcctaccagaacatttcgggcaccacccctttgggggatatagggcaactgtccgcgcagctcgacctgacccatgcccatccctcgggcatcgcccagctcttcgcctccggccaggttcaccttgatgccctcttccgtgacaacgccatgcttagggcggcccaccgccgcttggagcgcgtcttagacgaccggtcggccaaggagcgccaaagcggttcggcccagctctccatagtcgtcggtgtcgccagctggcagggcgccgccatgccggtcctgctttacccggtggaggtcgattccagccaggggacgggcagtaaggccttgattcgtttcactggccgggcccaactgaacgcttcgttcgtgtccgtgcttcgggggcggggcatcaggctcgacacagcttcgcttttcgacgcctcgcgttaccagggtggttcgatggaaacctccgccctcttcaaggccatcacaggtctggtcacccctcacatcagcgaattctctattgagcagcaggtgatcctaggctgcttcatcgagccttcggccctgatcctgagcgagagccaggacctcatcgatcagatggcggccgggccgaccggcaatgtcctgctggacgccctggcaggcgacgaggatgccttggaccaagtgcagggcgaccccctgccccagtacagtcctttcgacgcggaccctcatgcggagttcgaggtcggcgatgtggacaacaccgtgcgctacgccgcagccctggctgcaggcggtcattcggtcttcctggacgaggcctcgggccgtaacggcgtctccagcgcggcggccatcgcctcctgctgcgtgatgaacggccgcaccgtcttatacgtgccctgcgtggtggagcagaagcggcgattcgagcgctacatgcactcctaccggatggacgacctggttctggatctgaagtccaatcagagcaaaaaagccattgatcggcagttgattgaggcggtctccttcaaacccggcaaggccacgacccgcttcgaccagctggctgacgagctggtaggtgtacgcacccgcctgacccgctacctgggcgacctgcacggtgtttcgaagacctggggcgtgtccgcctatcagaccattcagaaccttgcccaggcggtcaacctgtccacgcacccggccacccgagtgcgcttcagcgtgcagacggccgggaacatgcgcgaccggatggacgagtggggcgctaagctggagcgggccgccgccctgggcgagttcacgatcgggcctcaagacaccccctggtacggtgccgccatcttcactggcgaggaggccgtcgccgcttacgggcgcgtggtccgcctgctcgagaagctcctgccagccactcgcaaccaggtggcctctacggtcgagacctgcgggctccctgtgccgcagaccgcccaggagtgggggcggcagatcgccatgctcaagaacctgcgccgggtgttggacgtcttccaaccagcgattttcgagcgtgacatccccgccatgatcaaagcgaccgagtccaaggacgatcgcaaatcatcaggcggttcgatgggcttctgggagcgccgccgcctggtcaaggaagccaaggggcttgtgcgggtgggcacacgggtcgacaacctgcacgatgccctgctgattgtcgccaggcaggccaagcaatggcgcactttcgtcccccatggcggctggccgatcctgcccgccaagctcgatgccatcctcgacacccacgaagccctaattcgcgacatgaccgccttggatacgattctggcctccaccccggccggcggcgacctggagacagccaccttcgaatcagtggaggaacggctgcgcgccctcttcgacgaccacatggctctgggcaccctgcctgagcggtgcagcttggaacgcgagttcaaggccgccgggctgaccgagctggttcaggacctgcgcaatcggcaggtgccccaggacgccgtgcgcggcgagctcgccctggcctggtggaccacggtcttcgacgacatcatgcactcttcccggatcatctccaaccaggatggctcggccctctccgcggcggcggagcgcttcaaccaggtggatttggagcacgtgctgagtgtggggcccatggtcgatcaggagagccagcgccggctggctgagctcttgttcggtcacaagcaggaggccaaccagctccacgcggccctggctggccgtgcgcgttcgagcctgaacgatgtcatcgactccttccccatgctcctggcggcagccaagccgatcatgctcgccacaccagccaccctggcctcgcagaccaagcctgagcagatagcggacgtggccatcatcgacgccggagcccacatgccatccattcaggtccttaccatcctggcgcgggcccggcaggtagtgatcgtggcccatcggcagaccatgacctccgacggcttggcccatgtggccgatatgctggtcccggttgtatccgccggtcacccctcacgccgccccccgcagatcaccgatttcctccaagagcacggctacggccctatcgccccggctccagcgcaagcaggcgcccaggggagggtgtcctacacaggtgtcagcggcagtggcgtgccagtgctctccactgggctggtcgaatccagccagcaggagatcaacgcggtcgttgcgatcctacggacccgggccgccggtttcggcaacgtgcccaactcgtacatcctttcaatcgtgaccctttccgacgcccaccgggtccgcttgggtgccgagctcaaggccttggccgccaaggatccggccttcggccgtttcctgcgccatgtccgcatcgtcgacatcgacgaagtggcgggcacggcctgcacggattcgattatttccgtcggtttcgccaagacctcccacggccgtctccttcaacagttcggcaaactggagggtgagggcggcgccgggatgctcctggacgccctggccttggctcagcgtcgggtcgatatcgtctgcgcgttcagttcggatgacatggaggaggaccggctccaccagagcggtcctcagctgctcaaggagctcctggcctgggctgagggccttgacgaggatgttccgtcccctgacgaggctcaggagggtggcaacgttctgttcgccgatttggccctgcgcttgcgcgaacgtggtttgagcgtggccttggactacggattcgacgaggggatgcgcatcccgatggtcgtgggcctggaggggcggccgttcagcctggctgtcgtcactgatgatgccgacttcatgcatacccaatccacccgcgagcgccatcggttcaggatggaagacctggaacgcctgggctggtcggctatgaccgtctggagcgtggccgctttcgtcaaccccgacaaagaagccgaccggatagagcagcaggtgcgcaagttggctgggcccagccagccggcatccccgcaggcctccgaggagacggcatgagcgcaggcccagtagcggactccgaggtcatgggaggaggctcacgcaagccgagagcccaccgaagggtggtgcgccgtggaaccgaacgcttcgaaggcgacgggctggacgataaccggctggatgggcgcgagcctgaagcccctggaagcaagcaggctgacgacgaccgccgcatcctaggcgagctgcctccgcactgggggatgttccctgcggagaggggctggactcaagcctgaggcccggcctgcccgggccgtccctgccattggtccgctttcatctggttgaggatggactgaaggagctggacggtttgctcgtcggcgctcggggtggccggcttgtcgtccttggcggacgaggcggcgtgcgcgaggttccgcagcttgttcatcggtaggatgatgcagaagtagatggcggcggccaccagcaggaagttcaggagatcgcccaggatggcgccgaaggagatcgtcgccttgccgttgctgatcgtcagcagtcccgacaggtccggcttgccgaagatcatcgcgatcagtgggcttaagaggttcttgacgattgagttgaccaccgccgtcaccgctgagcccatgaccacgccgaccgccatgtcgaccatggaaccgcgtgagatgaattgcttgaaccccgccagggggcctttgtcgctgatgttggccagttcgtgggccgcgtggactgcttgtgcggtcacagggttgtcgccggatgccatggtgtgtccttccctccgcgccaggccgtgcccttcctatcgaccggcctgtcgctttccattatggacccctcgacagacccgcgattgtggctgcgcccgcttaggcccagctgatcaccctccgcctgcggccagggcgatgatcggcgccccctccggcaggctcagggctttgatggcatcctcgggcttcaaggcgaaagcggtgagttcagcttcctgccctttgtctcctggccctaaggtccccgtcttgctccggtcttggggcagggccatcgtcacagcctcctgagcgatgaggcagcggcccttgacccagccctggccctcctcctgacccgattgcgcgggtgggctctcagccccctcgcagccggtcgaggagaccagacggaccctttgcccgggttggatggattccggggccgaggccagtgccaggcggatggtcgtcgtcccttggggctggaccggagagcggcccagggccgtgccggcgatcggttggccgggctctaggtcgataagcgccaacttgcccaaagcctgctcccgacggttcaggagttttgcggcgagcggggaggcgggcacttgctctagacggaccatgccggcctcgatgcgctcccctcgctccacccgacgggaggcgaccaggaccggcgtgcgcgccacggccccggtcacggtttgcagggcgcacaggacggccaaccctgcgcacaggcatgccgccagccgacgcacgcgcgtggcctgtcggcggccagccagcccgggcttgtgccctaggcctttgttcaaggacagtgaatgagacatggccccagcttgaccctgttgggcatctacgggcaagctggggccacctatgtggtcgaatgtgggcgagcggcgcgaatcagcccactggccgcgcgctcagtccttcttcgaggagtccgaggcgctggaggaggcacggtcggtacggtagaaaccgtgccctttgaactcaatcggcactgcggagtagaccttgcgcacctgctccttgccgcagtgggggcagagcgtgatggggtcgtcgctgaaggattgctcctgggtgaagtcatacccgcagttcttgcaccggtaatgataggtaggcaccgttcgttccctccgaaagttcgcgctataacgtttgttcgacaacctcatatcctagccccccggcgggtccttggcgccttgttcgccgcccgccgcttcggcgccaggcccggaaggcccttcccgaagccttacaatgaccgtatgtccgtcttccacagcctgtttgacgccctgcatcaggcggcggctccgagcgcgcccgacccgcccctggccgtgcctgcgcgtttgaaggcgcctgcgggacgcggcgacttcgccttgcggcccttgaccctggaggacgaggccgagtggagccgggtgcgttggagcaacaatgactggctggagccctggcagtccggcgacccccaggggcaaccgggactgacctacgcccagtgggtggaggccatgcggcgcagcgaggccgacgggtccggggtcgtcttcgcgatggttttccagaccgccatcgtcggtcaaatctccttgggcgccatccgctacggggccatgcgcaccggcttggctggctactgggtggatcatgcccgcataggccacggtttcgcgcccctggctctggccctcttgggcgactgggccctgcgctcgccggatggtccccgcctgcacaggatggaagtggccatcttgccggagaatgctcgctccctgcgggtggtcgccaagctgggcatgaggccggagggcctgcgcaagggctacatgtacgtgggtgggcgttggcgggaccacatgactttcagcctgttggcggaggaccttgacggtccgcttgtcgaccgtctaggggcttcgatgggcgacgcgccgcggaatgtttgaatacggggcatgccgtcatctatcgtaagaggtatggtttacgagtcgttgtccagcctgcttctgctgctgattgcggcgatacttgtgctcggctggttgcctggtcggacgatgcggggcatgaaacgcgcctcccagcacaggcaggaccgcatctccgcctcgctccatttggttgacgaaagcagcgggcgacggttcggcgacactgggcctcatagggcgaaagggttggttatgcagccacagcgggaggacggaggggaccgtcaggaggctgagcgcgtcaagagagtccgtctcatgcgccgggccgcggctcggcggcggcgtatcctgtccgcctccctactggtcgcgtcaattggcgtagcggtcttgtcgcaagtgctcgtcttcagtcccctgtacacggcgattcctctggccttattgatcctggtcctggtttccggcgcgcgcgcggccacccaggcccgccagtgggaggcgcggttggctgagcgtcagcggcgcaggaaggccaagcctcgccctcgcgcccaggcgcctgcccaggaggtcgtctcaacccagcagccaatcaggggcgaaaccacggacgcgctcagccagcaagacatccgcgcagccatcattcagtcgcgtcaagctcaggttcaggcgcttgaggcgcgagcccaggcccaggcccgtctgcgccccgccgcttccgctgagcgggcgaaggctgccgcgcagaaggctgagacccggggaagcgctctctcctccacggacctgccgaagcaggctgcgcaggcgcggacccaggcgaaatcgaagaccctggagccggaggcgaagccaggtgagagccatgaccacaacctcttgtctttctcgatgggcagcccacgtgagggtgttgtgccccgtgggccggaactcttgagccgggagatcaaatccaccaagcaggtgtccaaggccgtcccggtcaaagaccacgagcccctgcgggcccaggccgctcagcccagccgcgcgggtaagcccagccgtccggctgacttccaccagcgggaggttcaggccgatgtggatgcccctgagctcagcgaggactccctgggcaaggtgggtgtcgaggctattctggcccggcgcagcaagtcctgatcgacgagcgttcaccctcagcgttagcactcaagttggcagagtgctaatttcgcgctaccataatcactagcgcagcggaatgcctcggtgggtgttcgtcagcctctcatcggctttctggtgcgggtaaaccattgagcgtactcacagaaagaggaggtccacagtgtcgatctcactcacaccgttggaagacaaaatcgtcatcaagcaggctcccgccgagaccacgaccgcgtccggcctggtcatcccggattccgccaaggagaagccccagcagggcgaggtcctggcggtaggccccggtcgtcgcgatgacaagggcgagctgattcccgtcgacatcaaggtcggcgacaaggtgctctactccaagtacggcggcaccgaggtcaactaccagggtgaggactacttgatcgtctccgcgcgcgacgtgctggccattctcaagtaaaacctttcccctcttccttcgtttgcaaagccccttgggcgggtcaaccgcccgggggctttcgttgtcttcgcgcggcccggcgaggacctcccgcctccatgggtagccagtgtgacattgtgcacatgaataactaaatatggcactcgcctttcgttgaataactagatatagtgtttactgtgcttgcttgaggcggccaggaccgcctgcagagctccgacatgtgacaagctgaacgggaggtttcgatggagcagacagcgccaattgatcaggcggaggcgacaagttcgcctgaatacccggcgatgggggagcggatcggcgctctggtttatttttcgtcccaatcccagaacaccgcccgattcgtggctaactgcaagcttcaggacgagggcgtggacgtcttccgcatcccaattaagcctcatgacccgccgctgaacgtgcgtgagccctatatcctgatgctccccacctacgggggagggtcggcgcgcaaggcggtcctgccgcaaatcaagcgcttcctgaacgacccggcgaaccgggccggtatccgaggggtcatagcctcgggcaacactaatttcggcgaagccttctgcatggccggcgacatcgtctcacgcaaatgcaaggtccccttcctctattacttcgagctgatgggcaccaaggacgacgagcgcaaggtgaggcagggggtcgtggacttcttccgcaaccaccccgaataaacgaacccaggcggggccggggcagggggcggcgagcgagaacgctccgagcggcagagctcgggacaacactgatgaaaggatgccagatggcagcgcaggacgacacttcattggctttggacaggacggcggaagcgggggagacctatgaccccgcgcgcgactatcatgccctcaacgccatgctcaacctgtacgacaaggacggccgtatccagttcgacaaggacagggaggccgagcgccagtacatgagcctgcacgtggcggcccacacgaaagccttcgcctccacggccgagcggctgaagttcctgatcgacaacctgtactacgacaaggcggtcttcgccaagtacagcccggagttcctggaccgcatctaccagcacgccgcagacgccgatttcgagttcgagaccttcctgggcgcgttcaagttctacacctcctacgcgctcaagactttcgatggcaaggagtacctggaggacttcccccagcgttcggtcgccgtggccctggagctggcggacggcgacgaggacgcggccatcaagtacaccgatgaaatcatctccggccgcttccagccggccacgccgaccttcctgaacctgggcaaggcccagcgtggcgagcctgtctcctgcttcctggtgcgcatcgaggacaacatggagtccatctcccgaggcatcaacgcggccctgcagctgtccaagcgtggcggcggcgtggccctgctgctcagcaacctgcgcgagctgggcgctcccatcaagcacatcgagaaccagtcctcgggcgtcgtcccggtcatgaaactgttggaggattccttctcctacgccaaccagctcggtgcccgccagggcgccggcgcggtctacctgaacgcccaccacccggacatcctgcgcttcctggacaccaagcgcgagaacgcggacgagaagatccgcatcaagtcgctcgccctgggcgtggtcgtccctgatatcaccttcgagctggcgaagaggaaagagccgatggccctcttctccccctacgacgtggaacgggtctacggcaagcctttcgctgatatttccgtctccgagcactacgaggagatggtcaaggattcgcgtatccacaagaagtacatcgacgcgcgcgacttcttcatgaccctggccgagatccagttcgagtccggctacccctacatcctcttcgaggacacggtcaacagggccaacccgatcgacggccgcatcacgatgagcaacctgtgctcggagatcctgcaggtccaggagccttccacctacgatgagaacctgaactacaagcacatcggccgcgacatctcctgcaatctgggctcgctcaacatcgcgaaggccatcgacggtggcctggcggacacggtcgagaccgccatccgcgccctgacctccgtctccgaccacaccaacatcgaggccgtgccctccatcaaacgcggcaacgacgagggccacgccatcggcctggggcagatgaacctgcacggcttcctggcccgcgaaggcatccactacggctccgaggagggcttggacttcaccgacatgtacttcatgacggtggcctaccacgcctaccgggcctcgcatcagatcgccgtggaccgtggcagcgcgttcgcgaccttccccaagtccgcctatgccaagcccgccggcgctggcaactacttcgacaagtacaccgacggcagccgctccctggagcccaagaccgccaaggtgcgctccaccttcgccaagtacggcatcgatatcccaacgcgcgaggattggcgggagctccaggcggcgatcatccgcgacggcatctacaaccagaacctccaggccatcccgcccaccggttcgatctcctacatcaaccattccacttcctccatcctgccgatcccctccaagatcgagatccgcaaggagggcaagatcggccgcgtctactacccagcgcccttcatgaccaacgacaacctggactactatgaggacgcctacgagatcggctggaagaagatcatcgacacttacgccgaggccacccagcacgtggaccagggcctgtccctgaccctcttcttccctgacacgaccaccacccgcgaggtgaacaaggcgcagatctacgcctggcgcaagggcatcaagaccctgtactacatccgaatccgccagcaggccctggagggcactgaggtcaaggactgcgtctcctgcatgttgtaggctgacaggccctcagcgagccaggccaccctcacgcggacgggcggcataggaatgaacccaagcacaagcaatgaaggagcagaccgcatggtcccaccgatttcgataccccgtcaaccgctcaaactgattgaccgggtctcagccatcaattggaaccgcctggaggacgagaaggacctggaggtctgggacaggctgacaggcaacttctggctaccggagaaggtgcccgtctcgaacgacatcccctcctggcaggccatgagcgaggaggagcacacgctgaccatgcgcgtgttcaccgggctcaccctgctcgacaccatccagggcaccgtgggcgcggtctcgctgatcccggacgccctgaccccccacgaggaggccgtctacaccaacatctccttcatggagtcggtgcacgccaaatcctactcctcgattttctccaccctgtcgaacacgcctgagatagacgccgccttcgactggtcggagcataacaagttcctgcagaagaaagcgcagatcgtgctggactactacgagggcgacaaccccttgaagcggaaggtcgcctccaccctgctggagtccttcctcttctactcgggcttctacctgcccatgtacttctccagccacgccaagttgaccaataccgctgacctgatccgcctgatcatccgcgacgaggctgtgcacggctactacatcggctacaagtaccagaaaggcctggcgaaggtctccgagagcgaacgccagtccatgagcgattacacctacgacctcttgaacgacctgtacgacaacgaggtggagtacaccgaatccctgtactcgggtgtcggtttggtggacgatgtcaagaagttcctgcgctacaacggcaacaaggccctgatgaacctgggctatcccgccctcttcccctcggacaccaccgatgtgaacccggccatcatcgcctcgctgagccccaacgcggacgagaaccacgatttcttctccggttccggctcttcgtatgtgatgggcaaggccgtcgagaccgacgacgacgactgggacttctagcgcgactcgccgcgcggtccgcccagggccgtgtttttcgcgacacggctcagagcgaacttgcgcggcgggggaaaacgtggcaatataagcaagttgctgtgcggagcttatgttacgcgcagtaaggcggatttcccaagcggtcaaagggagctgactgtaaatcagccgcgtaatgcttcagtggttcgaatccactatccgccacgcctcggtagctcagtggcagagcacttccttggtaaggaagaggtcgtgagtccgattctcacccgaggctctctggcggggtagctcagctggctagagcgtacgactcataatcgtaaggtcaagagttcgagtctcttcctcgctacgaacgcagacagaagtctgcgtacacgactatagagggtgaaccatggcaaaagccgcagatattcgtcctggcattacgctggcgtgcaccgtgtgcaaggaacgtaactacatcacgacgaagaaccgtcgtaacactcccgaccgccttgagctcaagaagttctgcccccgttgcggtaagcatactcttcaccgtgagacccgctgaaagcggtccctaccaccagcccgtactggtatggtcttgaaagcccggctttgtgccgggctttccttgtattcggagggtttcgcgggacgggccccgaccagggaggaggctagactggctcctatgccagatgccacgtccaagcccaccgccacgcccaccttcgcggatttgaccacgattggcgtgggcggggctatcgcctccttcgcgagcccccgggaccgcgtgggcatgatcgaagctgtggagggcgccgactcgcgcggattgcccctgtgcgtgattggcggcggctccaacctcttggctgcggacgagcccttcgaaggcttggtcgtgcgagacgcgcgccaggagatccacattctggacgaagccgccccggtcgagtcggccgagcgcacggtccatgtgggtgccacggctgggaccaactgggacgacctggtggcctactgcttgcggatgggcctgtcgggcatcgaggggctctcgggcatcccaggcactgtcggagcttcggtcgtgcagaacatcggcgcttacgggcaagaggccgctgactcagttgagagcgtcgaggtgtgggatcggcaggataaggccattcgcacgtttggcgcggaccaaatggagttcggctaccgggattctttgttgaagtcttccatgtaccgggccccgggccggcccgacggcagctttttccccaccccccgttacgtggtgttgtcggtcacgctggtcctgagccacagcgagcagggccgggtggactccgaccagttggctcgggccttgggggtcgaggtcggcgcttcgatgccggccgcccgtattcgcgaggccgtgctggacatccgcgcccgcaaggggatgcttgaggatccgggccgctacacgaatccctggatgaggggttgccgggagtcgtccaacctggcctcggccatcggggccttgtccgagcggcagatggaagccggggaaacaaccggcggtgggccgagcgatctcctgctcgaccggcattcctgcggatccttcttcaccaacccaatcctgcctgcggatcaagccgcccgcctgcctgaggaggccccgcgcttcccggcgcccgccacagcgggggagggcgcggtcaagacctccgcagcctggctgattgaccatgccggcttccataaaggttacggccttcccggctcacgagccgcgctgtccagcgcgcacaccctggccctgaccaacaggggcggagcgagcgccgtcgaattggccgaactcgcccattccatccaggccggcgtgctcgccgcctacggtgtcgctcttgtccccgagccggtcttggtgggcctgcgtctggactagcggacggcgtcatccgcgccgctcccacaagtgttaaagggaaagacaatttaaaaacagttgtgagctacgccacatttttcctctgaatagactgaggccataccaagtaaagaaccgctcagagatgaacggccagtaggctttggggaggattagcatggatatgcaaggatgcattggctcggtggcgggtgccaagttcattgaccttggggccgttgccaagcagactggtgctgatgtggataggatgccatacacaatgcgcatcctgctggaaaacgtggtgcgcaaagcccaaggcgatgtggatgacgagaacgtacgtcgggtgctggactggaagcgtcatataggggaggccgtctccttctatcctgcgagggtgattctgcaggactacacgggagtcccctgcgtggtcgatttggcctcgatgcgtgacgccgccatgcggatgggcattgacccgaaagccgtcaaccccgagattcccgtggacctggtcatagaccactcggtccaggtggatgaggccggcaatccgggagcgatggcgttcaacgtcaagcgtgagtatgagcgcaacgcggagcgctataagctgctgaaatgggcgcagaagtcgttttccaacttccgcgccattccgcccgacacgggcatcatccaccagatcaacatcgagcacctgtcgccggtggtgcagtacgacgaccagctcggcatgctctacccggacaccgtcttcgggacggattcccacaccaccatgatcaatggcctggccgtgctgggttggggcgtaggcggccttgaggcggaagcctgcatgttgggcgccccatccatcttctcggtgcctgaggtggtgggtgtgcggctcacgggcagcctgccctccggcacggtagccaccgacatgaccctcgccatcaccaacctgctgcgccagcataatgtggtcggcaagttcgtggagtacttcgggcccggctatcagcagttgggcgtggctgaccgcgccaccctggccaacatggcgcccgagtatggctcgacctgcgggtattcgcctttcgaccaggagtcgatcaagtacatggagctcactggccgcagcgccgaaagcgtggaccgggccgcgtcctacatgcgcgccaaccacttgttctacgatccgcaggcggccgaccaggtggactacagcgaggtgattgagttcgacctgtccacggtgaccacctccttggctggtcctaagcggccgcaggatctgatagccctgccggatatgagccgggatttcgcgcaggaagtgaccgctccgctgggcaaccacggattcggcatggatgaggccgcgctcgaccagagcgtcgacgtggacatcgacgggcgcgaagagacgatacgggccggggatgtcatgatcgccgccctcacctcctgcaccaacacttccaaccctacggtgctcatcggggctgggctgctggccaagaaagccgtggagaaagggctcaccgtctcgcccaaggtcaagacctccttcgcgccgggctcccaggccgtgacgcgctatatggaagccactggactcatgccctacctggacaagcttggctttgagatagtggcgtatggctgcacgacctgcatcggcaactccggccccctccatccctcgatcgagcgggccctcaaagagagcggcatagccacggcagccgtgctgagcggcaaccgcaacttcgaaagccgtatccacccgctgatcaagggcaattacctggcctcccccatactggtcgtcgcttacgcgctggccgggaacatgcgggtgaatctgagcgaggaaccattggggcaggaccaggaaggccggccggtgttcctcaaggacatctggccttcaagcgaggagattgacgactacgtccgtcgttacgtcacctccgagtcctaccgggacgcctacaggaacatcttcgacggtcgtcgggagtgggaccagctgcaggtggaggaatcagagaccttcgcctgggaccctaagtccacgtatgtggccaatccgccctacttcgaccagcagatcgctggagtctccagcaagccggacctgactgggctcaccgttctggcgaagctgggcgattcggtgaccaccgaccatatctccccggccggggtcatccccagcctctcgcccgcgggccaatacttgcgcgagcatggcgtgcaggtgcgggatttcaactcctatggctcccgacgcggcaaccacaaggtgatgatgcgtggaaccctggctaacacccagttgcataatcagctggctgacggcaagcagggagggtacaccaagtacctccccaccggtgaggtcctgcccatattcgacgcctgcgagcgataccggcaggatggcaccgggctgatgatcgtggcgggcaaggattacgggatgggttcctcccgtgactgggccgccaagggggtcaagctcctgggggtcaaggcggtcctggccgagtctttcgagcgcatccaccggtccaatctggccatgatgggcgtggtccccctgcagttccagccgggggagaatgcgcagaccctggggctggacggcactgagagtttcgacgtgaggctcccggaacggccagagccgcgccagctcgtcgatgtggtcatccacggggagcatggcaaggagaaggtcatccaggccgtcatgcggttggactcgcaggctgagatttcctacctgggtgtcggcgggattctcaataaggtgcttgaaagcaagcgataacacgcagtcacatggttcgttggccgggacgttgcggtcccggccgcggcgggccgtactcataaagcggagagttcccgatccgcatggttgcccgttttcggacttcctctggcaggggagcctagtaggtcgaaagagcgcgggcggtattcgtacaaggagagaacgattatgttaattaccgttattttcgccctgttgcccatcttggtggcgataatgttgggcatgttcgccgcgaagcgcgggcacttcagtgataaagacagcagtatgctcatcaagttcgtgatgacctatgcgctgcctatgcacgtgttcggcggcatctggaagactccaaggaagctcatcatagaggacatcccgctggctctgtggatgcttggcagcatgttcgtgtgcttcatcgtgctgacggtcatctacgtcatggtgctcaaggccgacagggctgtatccaccctgcgcgccctttcggtggcggacccatccattcctttcatcggctcggcggtcctcccgctgctgttcagcgccagcgaaagcgccatcgtcatcggcatcgccagcctgatcatcaacgtgattctcttgcccttcgtgttcaccgctctggcggacaaggaagatacgaacgcgccgaagatcaacatcggtcagcgcttgaagaagtccctgaccaagccgctggtcatcgccgccttcctgggtttcgcgctcgccttggccgggctgcagatgcccaagcagcttgacagcaccttcacggtcctaggtaagaccgcagggggcgtggccatgttcgctacgggcatcgtcctggtgacacgcaagatctccttcaacaagaatgtcttcatcaccgtgttcctcaagaacctggccttcccgctcgtcatctggggcctgatggccgccactgggatgcccggggatctcacccgcatcgtcgtggtcaccatgtcgattcccaccgcgaccatgcccacgaacctggccatcgagtaccagatcaatgagtcggaaatggcctccacccagttcttgagcactattctttccttcatcacgctgagcgcggccatgttgctgttgagctagcccgcctatgagggataagaacgaccaaacccgatccatgaacgcgcggtaggtagaaacgaggaagcaatgggcaatgagcaagagatatttgagatgcatgaacgccatcggggggttcttggtatcgaagcggaatatgacgtgcgcggcaaggaggaacttggcaagctctatacgcctggcgtggcgctgatttcccgggccatcgccaaggatcccgaactgcggcaccgctacacgatgagcggcaagctggtggctctgattacggatggttcggctgtgcttggtttgggagacattggcccgtccgccggcctgcccgtcgtggaaggcaaggccctgctctacaaggacatggccggggtcgacgccctgcccatggccattgcccagctgcccgtggacgagttcgtcgatacggtcgccaatatcgctgacagtttcgcgggcatccacctggaggacatcgcggcaccccgctgttttgagattgaggacaagctcgcccgccgtctggatatcccggtctaccacgatgaccaggaaggcactgcgatcgtggtgctcgcggccctgatgaacgcggccaaggtggtgggcaaggagttctcccagctcaagctggtcatcaacggcgccggcgcttcgggcatcgcgaccgccaagctcctgcacgcggcgggcctgagccgtatactcctggtcgacaaggaggggttggtgacggcgcaagatgagggatacaacccctaccagcgcgcggaggccgacaatcccgatggtctgcccgcgcgctcgccgttgagcgaggtcatcgagggatgcgacgctttcatcgggctgtccgtagccgacgcgctgaccccagaggatatcggtcgtatgaaccagcgccccatcgtcttcgccctgtcgaatcctaagcccgagatcgacccccagctgttggggggcacggatacggccgtcttcgccacaggttccagccagtaccccaaccaggtcaataacgtgttggcctatccgggtttgttcaagggcctcttgcgggccggcgtcaaacgggtcagcctggacttggaggtggccgccgcccgcagtctcgcccagctcgtggcccaaccgagggcggacaaggtgataccgggggtcttcgacccgggtgtggtggacgcggtctgcgcggcggtggagaattttgccagggaacatacgattcgcacgaaggagcaagcagagtgaatatcaatcacgacgcatcggcgggcagtttggagtcctgtgacatcatcgtcacgctcctgccggcccaggaaggtatttccatcgacttggaaagcagcgtcaaggaccagtttggggtccggattgaggaggagatccgtcggaccctggacaggctgggtgtcaccgcggcccaggtccgggctcaggaccagggggcgctggattgcacgatcaaggcccgcactattgcggccgtctaccgcgccgccgaccggcaggatgtggattgggaggagattaactcatggatagactgagacgcacgatgatgttcgtgccgggctccaatgcagctatgctgcgcgactgcacgctgtacggcgcggattccatcatgttcgacctggaggacgcagtctcgctcagccagaaggacacggccaggcttctggtgtattcggcgctgaagacctttgactacggcggcgtggagactgttgcccggatcaattcccttgaggccgggggagcccaggatgtggaggctatggtcctgggcggcatcgacgtgattcgactgcccaagaccgagaccgcccaagacatccgcgacgtggatgagatcattaccgccgtggagcgcaagtacggcatcgagcctggcaggacccgtatgatggccgccatcgagggggctgctggtgtgctgaacagccgcgagatagcccacgcctcaccgcgcatgatggccatagccttgggcgccgaggattatgtgacttctcagaagacttaccgctatcctgatggggctgaactgttcttcgcccgcaacttcatccttcacgctgcacgtgaggccggcatcgccgcgattgacacggttttcagtgacatcgacgatgaagaagggcttgtccgggagaccaaactgatcaagcagttgggatttgacggcaaatctgtcatcaaccctaggcagattcctgtcattgacgggatttttgcgccctcacccgagcaggtggccaaggcgcggggcattgtcgaggggcttaaagaggccgaatcccggggttccggggtcgtggcggtcaatggtcagatggttgataagccggtggtggagcgggcccagcgcacgctggctctggcccaggcttcaggaatgaaggtggaataatgacgcgcaatgcactgaacagggaaattcccgagccctactcctcctcctgcggggtgtacgaggggcagttcgcgcacatcaatgattaccaccgggccgctcctggggtccatccccgtaagcctggcgattccaagctcctggattccatccatgaggcgattgtgcgcaccggtctcaaggacgggatgaccatctccttccaccaccacttccgcgagggcgaccgcgtgatgaacctggtcatggaggagatagaccggatgggcatcaagaacctctcgatcgccccttcctccatcgccaacgtgcacgagcccctgatcgactacatcaagcggggggtggtgacctcaatcacctcctcaggattgcgggataagctgggcgccgccatctcccacggcatcatggacgagccggtgatcatccgctcccacggtggccgcgcccgggccatcgtttccggcgagatccatatcgacgtggcgttcatcggtgccccctcctgcgacgagtacggcaacatcaacggcactgaaggcaaggccacctgcggttcattgggttacgccaaaatcgacgccaagtacgccgaccaggtggtggccatcaccgacagcctggttccctatcccaacacgccgatctccatccctcagacggatgtggattatgtggtccaggtggattccatcggagaccccgccggcatcgccaaaggcgccacccgcctgaccaagaaccccaaggagctcctgatcgccgagtacgcggccaaggtcatcaccgcctccaagtacttccgaccggggttctccttccagaccggcaccggcggcgcgtctctggcggtcagccgctacctgcgccaggccatgaaggagagggacgtccatgccagcttcgccttgggcggcatcaccaactccatggtcgagatgatggaggaggggttggtggataagattctggatgtccaggacttcgaccaccccagcgctctctctctggccaggaacccccagcattatgagatagacgcggagatgtacgccagcgccctgtccaagggggcggccatcaaccagctggacatcgccatcctgtccgctttggaagtcgacaccgacttcaacgtgaacgtgctgacaggttcggatggtgtgatccgcggggcctccggcggccattgcgataccgctgcggcctgcaagatgagcatgatcgtggccccactggtccgcggtcgcatccccacggtggtcgaccgggtcaacacggtggtcacccccggtgattcggtggatgtggtcgtcaccgagtatggcgtcgccatcaatcccgctcgtcccgatttgcaggatatggccaagcgcctggacgtgccgtgcctgaccattcaggagctgcgcgacaaggcctattccatcacgggccggcccgaccccatccgctatggcgacaaagtggtggctgtggtcgagtatcgtgatggcagcttcattgacgcggtgcggcaggtgggtgagtccgcaacttgctagggtgggggataccccccaaacgcctggaacgaggtgggtcatggaggtaatcaaaggcgtgcatctggatgccaccggcgctctcaccgatgacgtggccgaggccatcaagagtaacgtggacatcaacaagcacagtacggttcgagagaacctctatgaagcgctgcgcaaggctgtcatccagggagatatagaggatggcgcctggatcagcgaatcctggttggcccaggagctcaacgtttcccgcacgccggtgcggtacgccttgaaccgcctggcggacgaagggctcctggtctcccgtcccaggatgggggtcatcgtcaagggcgtcagcgctgatgacgtccgcgaggtgttcgacatccgcgagcgtctggaggctctggccacccgcaccgcgatgcgccgcatggattccagccagtttcaggagctcaggaccttactcgggcacaccgagcattgttacgagcgaggtcagttcgatcaggccatagattgcataggcgagttcgaccgcttcatctatcgggcgagtgagctgcctcggctggcggatatagtccttgagcttgaggactatctgcgccatttccgcctgctggcgctctcccgaaccgagcggctgagtcaggccatccaggagcaccggcgcatctacgaggccatgtccgccggcgacgagcgccaggtcaacgacgcggtcagcgatcacttggcgcattccgagcggtacctgctctccctcatgcaggctaggcgcaccgccgcacgaccgggggaggcgcaccaatgacgcttccgcaacgcatgtggctggatctcgatcctgtctcggaaaccgcctggaggcggctgctgacccagtcgggtcttcatcccgacctgcaggtggactacacggttggcgtgttcgagggggggcggctggtcgccactggctcactcctgggaaatatcatcaaggaagtggccgtatctccccagtctcagggcggtaacctgctctcgtcagtggtgcaggcgctcctggaccggctggctgaacagggcttgactcatagtttcgtctataccaaaccggaaaccgccgggtttttccgctctttgggattccgccaagtcgctggcaccgacaaggccgtgctgttggaacaggggtaccccaatatccaggattacctgcgctctctggacgagcgccggctgccggggtccgatgcggcggccatcgtgatgaaagcggatccgcccacactaggccacgcttacctgatcgaacgggccgctcatgccaacgacgccctctatgtgttcgtcctctcttcccgggacacgctcctgcctgcccaagagaggatgcgtctagtgtcacgcatgtgccgcgaccggccgggagtgagcgtactgcccactggtgattatctggtctcggcggccactttccctagctatttcctcaaagacaaagctcgcggggaagtggcccgggagcaagcccggctcgacgccaccatctttcgcgatctcatagcgcccgcgctttccatttcccaccggtacgtaggccaggagccatacagcgcggtcacggccttgtataacgaagagcttgggcgtgtgctccagggcagccccgagctggtcgtgctgccgcggctggctgtgggcggcgtcccggtcagcgccagtcaggcacggcaggcccttgccgacggcaatcgcgacaagttgcagtccctggtctgccccgggcttgcggatgagatatggcgctgcgccagacccggacaagatgggaaggaggcggacgatgctaagaacgcgtaatctggatggcccacaggtggatttggggcaaatgctggccgctagggacgctggcgttgccaaggagcgcgagctcttgcgggcccacccgggttccgttctcattcatatgagtatgcgtatacctggtccggtcaagacaggcgctagggtcgaagccgtatttgatcaggccgaagcctttctagcgcgaagtcaggcggacaggctcctggatgagcgagtgaaccacctgccgacgggtccagtggcctatatggtcgtgcgtggcgacttgaaatcactcaaaaccgagatgctgactttcgagaatgagcacgacttgtgcgatttgcttgatgtcgacgtgatggaattggaacatgatggactggtccagctgtcccgccgcgatctgggcttgggaccgcgggcatgtctgatttgcggcggcgatgccaaagtctgctcgcgctcgcgtaggcatggcttggagcgggtgcttcaagtggttgaggccatcgtggatgagggctggaagtgagacgttcgtttcggcgcggtttcaatccgcgatggatcaaattcaggaggcgtggatggaccctgtagcggcgatggtcgccaagaacatgctgccgtccagggagcggaccataggtgagaccatataccaggccttgcgccgaaccatcgtccttggcgagattccccggggttgtcggattaatgagaagatcatggccgaagccctgaacatctcgcgaacccctatccggcatgcggtggagcgcctggaccaagagggcctggtggagaggcgcagcggtgtgggagtcgtcgtcaggggcatctccattaaggatgcccatgagatctttcagattcgtcaggagctcgattcgttggccaccgttcgcgccatggatctgatgggcccgacccagttcgttgagcttaaggccgcgcttgagcagacggaccgattggacgctgctggcaaggtggtggaagtgacccgtaaattcaccgagttcaacgatttcatctacgatgccagcaaaatgccacgccttaaaatcatcatcaaccgcctcaaaaactatctggtgtatttccgggatatcagtgtcaacggcgacgaccggcggcagctggccatcaaggagcattggctcatataccagggcatggctgctggggaccacgagcaggtggagcggatagtccacacccacctggatcattcgctcgattttattctcaaggtcatgaggtcaaggaacattgcgtagccaactacccgagatagcgcgactcgcctcccaagccttggtctcggaggttatgctggctccaaagccgggcttggtggaccccatctccaatggagcgcactccgacatggatgtggatacgttcctggccagcgtcggggcgctcgccccctttttccccgaatatctcgaattgggccgacggtccaccggcgagcaagatctctaccatcagctcaggcggaccggccgtcaggcggaggcgagcatgctgagcgtcaccggaggtgttaacacgcataagggggccaacttctccttgggtttcctattgggcgccctgggcaggctcttggcttccgcctccctgtcccagctggcggcggcggacttcgctccgctttttcccctggtttcccgcctggccgccgcttccatggaagaactgaccggcctcgaccagcaagacggtttgagccacgggcaggaggtttatttgcgcgatggggcggcgggcgtgcgtggcgaagcctgcgctgggtatccaatgttgcgtctagtggtcctgccgtatctgcgctccagtcccgagtacgcagacacgcgttacttgcgcctcatgacgctgctcatgtctggcttggaagacgccaacctgcttcatcggggcggccgtccgggactcgtattcgtccaaaccaacgcccgcgcccttcaaacattacccgccacctgcctggctcaagccctccgggactttgaccgggaattgattgagcgacatttgagcccgggtggcagcgcggactatctgtcgctggcatatttttttgacgggcttattgaattagccgactgctgaccgccgccgttccttcggtccagcgccccgcgttttcggctccctgccctatgatagaggtctgatcatcccccaaggtacgagacgaggtagtttttcccatgcatgtgttcaggaccaaaaccgtcgagcagaccttggccgagaccggtgaggaggggcgcacgctcaaacgcaccctgtccacttgggacctcgctgtcatgggggtggcggtcgcggtcggcgcgggcatcttctcggtgggtgcccaagcggcggccttccatgcgggccctgcggtcattctcagcttcatcatcgccggcgtggtctgcggggcggcggtcatgtgctacgccgaattcgcctcgatgatcccggtctccggttcggcttacaccttcacctacacgacgattggcgagatcgtggcctgggtgattggctgggatttaatcctggagatgatgatggccgcctcggtcatctccaagtactggggtgtctacctgaacgacttcatccacctgatgggcgggcaggggttctcgaccacggtcgcgttcggcggcttccacgtggacctggcgcccctgttcgtcgtcggtctcttcaccgtcctgctgattctgggcaccaagatgtcggcccgcttcgacggcgcgctgaccatcctcaagatcggcatcgtcctgttcgtcatcattgtcggcttcttctacatcaaggcagagaactaccaccccttcatcccgcctgagcagccggcttcgtcaatcaagggcctggaggtcacttcgaccatggccgagcccctctggcagtgggtcaccggaatgagccccacagcctacggcgtccccggcatcctctcgggcgcggccctggtcttcttcgccttcatcggcttcgatgtggtggccaccacctccgaggaggccaaggacccgcgcaggaccgtcccgcgcggcatcttcctgggtatggtcatggtcatcatcctctacgtcctggttgccatcgtcaccaccggcatggtctcctacaaggacctggccaagtctccctcgccctcccttgccacgggcttcgagctggtgggcgccagctgggcggccaagctgatctcattcggcatcgtcgtggggctgaccaccgtggtcatggtcctcctgctggggctgaccaggatcgttttcgccctcagccgtgacggtctgctgccgcgcggcctgagccagaccggccgctttggcaccccctcccggatccagctgatggccggcatcctggtcgctgtcgtggcctgcttcttcaatatcgacgtcttgtccgacatggtgaacatcggcacgctctccgccttcatgctggtggccctgtccgtcccgatcatgcgccgtaagcgccctgacctgccgcgctctttcaagatgcccggcaacccggtcatcccgattctgatctccttggcctgcctgtggctcatgctcaacctgaccgtgctcacctggatccgcttcatgatttggctgctgatcggtttcgccatctacttcagctactcctaccggcactcccgcttaggcgaggagctcctcagcgacaccatctccgctgaggcgctcaaaggcctgaactgagcgcccggacggtcctcgggactggttagtctggcactacttaggatgaggagggactcatgacgtatgtgattgcgcagccgtgtgtggatgtgaaggataaggcttgcgtggatgagtgcccggtggattgcatctacgagggtccgcgtgacctgtacatcaatcctgacgagtgcgtggattgcggggcgtgcgagccggtgtgcccggtggaggcgatcttctacgaggacgacctgcccgaggattgggcctggtacaaggacgcggccgtcgacttcttcaaccaggtcggcaacgcgggcggcgcccaggcccacggcccctacgaccacgaccacccccaagtcgcagccctgccaccgcaaggtcagtgacgccgcgatagtggtcttctcaagcagcccggcccgcttcacgcgcgccgggctgcgcctgttctcacgggtcctttggggggctcttcggatttccgcgaccggggggagggtcggcgctcacagcccgaactttacggctccctgtccgtagcggccgcgaatcgaatccaaggcccgctcggccgtcgccaactgggcccgcctcaggctctctgtttcgccctcctcctcttgcaggacttcatccagcgaaggttgcaccggagtctcctcggccttgctcagcgaggaggcggacacacccgccaggcggatcagccggggcagttcgccgctggccacctgctcctcggtcatgttcagcatggtctgaagcagtcgcattgcctcggggtggatggctgaggcagcgtggaggggcacacgggaagtatgggatttcgtcatgtatttcaggtcgtcgaagcgcagtttgactgtgatggtccgggccaggagccctcgcttccgcagggatgaggccacctcgtcactgcattggcgcaggaggtccgagaccgccttgagcgaagccgtgtcctccaggaaggtgcgctcagccccaatcgacttttctggggtgtagggggtcaccacccgcttgtccatcccctgtgaggccagagccagcgtatgggcgctgatgcgcgagccggtggcttggaccagctcggcctcggagctccggctgagggcggccacatcctcgattccccagtctttgagccgtttctccagggcttggccgatgccggggatggcgcgcaggggcatgagttggatgaactcggcctgacgggcgcgtgggatcagcagcatcccgtcgggtttggcgttggtcgaggccatcttggcgattaacttgttggaggccacacccaccgaacaggtcacatggaagagggcggccactcgctgccttatccagcgcgcgatgttggtcggacgcccccagcggcgcaaggccgcggacacatccatgtagcattcgtccaccgaaacttgctccacctggtcggtcacccgggcgaagacctggctgaagatgctccgggagacggctcggtagtaactcatgtcaaccggtaggaagattccgttcggacataggtggcgggcgcgagccaccggcatggccgaattgatgccgtaggggcgggcctcgtaggacgcggcggagaccactgagcgcgggccggttcctacgatcagcggcagccctttgaattcggggtgacgggcgacttcgcaggaggcgtagaaagcatccatatcgatatggagcacagtgcagccggtctcgtcgccgccccagtcgcgcttagcggcagccagtctcggtgcagtgctcatgcctccatcctatcctccgcctgcgccccagcatatccgccccttgcctggtgggagaaagcccctgccacgcttgccggcagtaagggaaaccggacgctacggcgcgtctgaccgccctaggtgatagtcttgtttgttgtggtcttaagcaggctttactctgcgctaagccacggagacgtgcctgagtggccgaaaggggcaccctgctaaggtgttgactgtgcaaacggtccaggagttcgaatctcctcgtctccgcaagaagcggtaagaacctgggaatcgttggtgccaacggtccccgggttcttgctatgcctggctggacggagaaagcgggtgagctgtgaggggcggccgggccttggatcgggcgctgcgtatgggctcgcttggcgggcgatgcgctaccgggtttttgcggcggccggtagtgtcgtcgatgggactgtgactgaggtcgccgctgtcgaagtcgcatttggtttctcctcccgaagggggtggggaggcggggaactgggatagacttgactcatggtccgccggcactggagccgtgcggaaggcgacggcagcgatgccgcagtgataaaggaaacgatatggatatcgcattcacgaccaaattggcggcggaattcataggtacggccatactgatgattttcggtaacggggcggtggcgaacgtggagctcaagggcaccaagggctatcattccggctggctcaccatcgcgatgggctacgggttcggcgtgatgctccccgtgctcatgttcggcggtatttcgggcgcgcagattaacccggccatgacgatcggacaggcggtcaacggcatgttcccctggtcgcaggtggccccgttcatcctggtgcagctgctgggcgcggccgccggacagctgatcgtatacgtggtctactatccccactacatgcagaccgactcgccccaggcgattctggcctccttcaccactacggacgcttccgaatccaaggtcaactatttcattaacgagttcgttggcacgctgctgctggtgctgggcgccctgtgctgcctggagggcgcttggggctctaagaacaaggcttcggcggccatcgtggtgggcttcatcgtctggggtctggtcacctccttgggcggccccaccggccccggtctgaacccggcccgggacctggtgccgcgcatcctccaccagttcctccccatcccccacaagggctcctcccgctgggacgaggcctggattccggtcgtcgccccgatcctaggcgccatcctaggcgccttcctcttcaaaaccctcttcgctctctgagcggcttgggcagctggcgacgcattcgtccgcgttttcaccgcttacggtcgtagccacaatcgcgatgcttacgcgctgcgattgtggctaggaagggggcaggcatggcgcgaacgtctttgcctcccctgatttggcaagggcgggaccgagagcgcgggtggcgggttcggcctggttcagaggggctggtagaaggcggtggggccttggtcttgggggcttatctggccgttgaagaggttggtcaggctcctggtgaaggcttcctgttggtcggcgggcaggtcgatggtcaggctcactcggtcggtgaactcctcgctggccacctggccctggctgtgttccaccagttgtttgagccgctcgtagcgtgggtagtccaccctgaccatcagccgtcgggcgggcgtaatcttcgcctgcttggccgctttgagagccagcgaggcggcggacgagtatgcgcggataaggccgcctgagcccagcagaatcccaccgaaatagcgggtcacggtcacgatgcaatcggtcatgtcgttgcgccgcagcacttccagaatcggcttgcccgcagtccccgatggctccccatcgtcgctcatgtgctccgacagatttcctgagccctgtcccgcgtgcgcgctgccggcgttgtccgagccggtcagtgaggctgggccggccgaatcccctccccaaatagcgcaatggcacacatgccgcgccttggggtcagccttccgccgcgcggccagaaagtcaagcgcttcggccgccccgcttacatggcagaccgctccgatgaacaccgatttacggtcctcgagctccccaaccgccggctccccgggcaggtccaacaccgtccgcatcccgcctcctcgttactcccaatcccctctaccgacaccaacaaccttctcacgaatcttcagctgcttcgcgggccgggaggaagcgggcgggtggtaaacagctcggctggttgcgtttgggtgcccgcaggacacctgggacgctgggtcctgcctccttggaaggccggcgggtccagagaaccggtctgtccgcagcattcaggatttcataatgcagcagcataaccgttgttttccgcgctcgccggttccgtcctgcgagcgttcaggtggcttgttgccgcgtcatggttttactctagggcactagcgtttatccgcgcaatttccgccgggtgaagcgcctgctctcttcccagggttcaagcgttcgcgattttccgccacggcatctaaatctggcgctttgcttagtattgaggtcatgagcgatgcgcaagagcagcaggaggagagccggcccggtgaggcgttgaccgtctcgtatgagcggctgcggcactccgaggattcggccgagctgagcgccctggcccgccggcctctccctgatcgttcggagcaggcggcgttctcgcgagcaacggctctgctggaggcggtggccggcaacgagcacacaccggtggaggaccgggtgagcttggcccagaacatgcccttcccgaacatcctcgtcaagctctcccgggacccgcagccagctgtgcgccgggccgtcgcggccaataaggccgataagaattggctggtgggcctcctgaccaaggatccggacggcagcgtacgggcggccgccctgaccaatccgatgacttcgtggaagatgcgcctggagggtgctcagagcgaggatacggatgccgatactttggacttcctcgggcagctgggcgtaggcgtggagcctgacgcgccagtggtcctggccacgatggtccgccgggccgtggccttgaacccggcaaccggttcgggcacaatcgaacggcttaggtccgataccgaaacgcaggtgtccaaggccgccgcatcccgttaacggacggtcggtccgggctcgcaagcagggctgccggcccgacgccgacgcgcgctcttgacgggtttgtgccaagtctaggcccaggctacaatggtgtattgttgtgtttccctcaggggtcctcaaagcgcttttcccactcgccgtctaggacttgcagggagcccacggataatgcggttttccgcgcgttgccttacggcgtggcggggagcccgaaacacaatgcaaggaaaaggttgaaactgtgaaaacgttcaccccaaagccggctgacttaagtcatgactggtacgtcgtcgacgcctccgatgtggtgctcggccgtctggccgcccaggtcgcgaccctgctgcgcggcaagaacaagcccactttcgcgccccacgccgactccggcaaccatgtgatcgtcatcaatgcgtccaaagtggccctgaccggcaacaaggacggcaaggtcctgtacgcccactccggccgtcccggcggcctgcgtcgcgattcctacggcgagctcatgcagcacaaccccgagcggattatcacgaccgcggtcaaggggatgctgcctaagaacaagctggccaaggtccagctgacccgtctgcacgtctatgcgggcgaggatcacaagcaccagagccagcagccgaccgagttcaagatcactcaggtctcgcagcaggccaagtagaaccgaagggaatgaatactatggctgacaacaacaacagctccgcggttcttgaagccgagcagaccgtgtacacctccgagaccaactccggcgctggcaccggcacctccgcgatcgcgccgggctacggcacgggtcgtcgcaaggaagcagtcgcccgcgtgcgcctggtccccggcaccggccagtggtccatcaacggacactcgcttgaggagtacttcccctcccgtctgcaccagcgtgaggtcaactcgccgatcgtgcttctgaagctcgaaggcaagttcgacatcaaggtgctggtcgacggaggcggcgtgaccggccaggcaggcgctgttcgcctgggcgtggcccgtgcgctgaacgccatcgaccgcgacgccaaccgcgccgccctcaagaaggctggcttcctgacccgcgacgcccgcgtcgtcgagcgcaagaaggccggtctgcacaaggcccgccgcgcgcctcagttctcgaagcgctaattgctccaggccgcaaggcttacggctggaacccccgctcgtccttcattggacggcgggggtcccgcatatttggggaaaggtgcgaagatgaagattatgtgaagataccgtgaagttttgttgtgaacaaccggctgtactgggatactcaaagaacgatacctctctcgcgacacggccgtcccttccttttctggtgggaggtcccattctttttttctttacgctggccatagctctacctgattaggtggtacctcatgaatgaccacacctactcccgcggtgccgctcgtgccttgaccgctttggctttgggcctgctggtggccctgcccaccgctgcatgcggttccgctggtgcctcttcggaccctaagccggtggccgcggagcatgatccggtgtccccggctgccagtcacgaccaggatccggcccagcgccgccaagacaagcaggccggctcgatcgccgagctggctcagcgggccttggaccagggcgccggtgattatcagggcgccatcctgaggcgcacggtccagtccggttccatgaatgcggccgattacgaggatgcctggtccaaaatgaggcagtgcgtggctgaccaggggtatcctgagtattcgccccataaaacctctagcggcatctatagcctgacctacgagtcccagtccggcgcccgcactgaaaacagctcctatggacaggccgtcgcccagtgtcagcagcgctacgtcgcggacgtttcgcctatttaccagacccagctgggcaatccgggtctgtatagggatacccagcaggctgcgattgattgcctgcagcgggccgggttcgtgcccaaaagctatacggttgagcagttcgaccgggagcgggctcgttcggatggcgacgaatccaagatggcctttgatttcatgagcccgcaggcccagtcctgtctggtgcccaacaacatagacatgctcgacgtgaacgattcgcggggcaagtagccgcgcgatgtgctcaggccagcgcatctggatttaagggggttggcccgcacgtctgggagtcgcacaataaagcgcacattctgcatataaaaatgaacagtatatgctgaattgtgcgcacatgacacgccgcaaattgcacgaaacccgttcgagtggcgcgaactcgcccctttccgctacattgtgaatctggtcacactagttggccaagcagtgagcaggatagacaagggcgccgcatccgaggggtgtgtgctcttggatggggtgccgagccagaccgtcacaaggaggggctgtggtttcggcgcgtaagacatcaacgaagatccaagacatcaaggaagcgcagagtgcccaggatgaggtggacgccctggttaccaaagcgcaggccgccctgaccgagttcgagaaactcgaccaggagcaggtggaccggatcgtggccaaggcttcgatcgctgccctcaacaagcacctggagctggcgcagatggccgttgaggagacgggccgtggcttggtggaggataaggccaccaagaacatcttcgcctgcgagcatgtgaccaaccacctcgcccaccagcgtacggttggagtgatcaacgactacgacgtggatggcatcgtcgagatcgctgagccggtcggtgtggtcgcaggggtcacccccgtgaccaaccccacctccaccgctatcttcaagtcgctgatcgccctgaagacccgctgcccgattgtgttcggcttccacccgttcgcccagcgatgctccacggccgcggccaagatcgtgcgcgacgccgcgatcgaggccggggctcctgccgactgcatccagtggatcgagcatccttcggtcgaagcgaccggcgcgctgatgaagcacccgggtgtggcgaccatcctggccaccggtggacctggcatggtcaaggccgcttattcgtccggtaagcccgcacttggcgtcggcgccggcaatgcgccggcttacgtggacaagacggtcaatgtgccccgcgcggtcaacgatctgatcctgtccaagcacttcgactacggcatgatctgcgccaccgagcaggccatcatcgcccacaaggacatttacgcgcgtctggtcgaggagatgaagcgccgcaaggcctacttcgtcaacccggaggagaaggcgctgttggagcgctacatgttcggcgtgacctcctaccccggtaaggatgctcccgcccccaagctcaattcggttgtgccaggcaagtcgccgcagtacatcgcccgcgaggccggtttcgagattcccgaggatgccaccatcatcgccgccgagtgcaaggaagtcggcgagatggagccgctgaccctggagaagctggctccggtccaggctgtgctcaaggccaaggacaaggaccaggccttcgacatgtgcgagcggatgctgaaattcggcgccgggcacaccgcggccatccacaccgacgaccaggacctggtgcgcgaatacggcctgaggatgcatgcctgccgcatcatctggaaccagccctcatccctgggcggcatcggcgacatctacaactccatcgccccgtcgctcaccttgggttgcggctcctacggcggcaattcggtctcgggcaacgtccaggccgtcaacctgatcaacgtcaagcgaatcgcgcggaggaataacaacatgcagtggttcaaggtcccggccaagacctacttcgagcccaattcaatcaagtacctgcgtgacatgttcggcatccgtcgtgctgtgattgtgtgcgacaaggtgatggagcagctgggcatcgtggacaagatcatcgaccagctgcgcgcccgccgcgagccggtcaccttccgcatcatcgacaacatcgagcctgagccgagcgtggagaccgttgagcgcgggtcggagatgatgcgcgacgatttcaagcccgacaccatcatcgctgtgggcggcggctccccgatggacgcggccaagatcatgtggctcctgtacgagcacccggagatctccttctccgatgtgcgcgagaagttcttcgacatccgcaagcgagccttcaagattccgccgctggggtccagagccaagctcgtgtgcatccccacctcgtccggcaccggctccgaggtcacgccctttgcggtcatcaccgaccacaagaccggttacaagtacccgatcaccgattacgcgctcaccccgtccgtcgcgatcgtcgacccggtcctggcgcgcacccagcccaggacgctggcttgcgactccggtttcgacgcgctgacccacgccaccgagtcgttcgtatccgtgtatgccaatgattacacggacgcgatggccctgcgcgcggccaaactcatctgggacaacctggacatttccgtcaacgcggctcctggccgtgaacggacccaggcccaggagaagatgcataatgcgggcacaatggccgggatggctttcggctcggctttcctgggcatgtgccacggcatgtcgcacacgatcggcgccttgtgccatctggcccacggccgcaccaacgccatcctgctgccgtatgtggtgcgttacaacggccaggtgccccaggagtccacgtcctggcccaagtacagcgagtacacggcctccgagcgttaccaggagctggcgaacgagctgggcatcaagtcctcatccccgcaggatgccgtggagaagtacgcgcaggccctggaggattaccgagacaacaagctgggcatggactcttccttccagtccgctggcgtggatgaggagtacttctggagcgtgcttgaccagatcggcatgcgcgcgtacgaggaccagtgcactcccgccaatccccgcgtcccgcagatcgaggatatgaaggacatcgccatcgccgcctactacggcgtcccccaggaagaggggcatgcgaggcgggtggctcgcgaaggcgaagccgccaccgaggaggcttcccagcgcgtcggctgaggggtgttgaggccgggctggttgccttcgggcgcgagcgaccaccggcggccttgcctcagagccacgtgagggacggtcgagaggctgccggctgcgaaaggtcggcggcctcttttctatatcggcggccctgctgatcctgtcgctgcatcgcggtaaccggcgaccggccaaaagtcgccggttcgggcgttggttgacgccgagggcgctggtctgcctccgctcttcgtggacatgcgcatcgagcgtgtcggctgctgggaccgtgtttgccgccggccgcccgccagcgttgagtcctgcgtggaatcattggactggtcgtgctaacctgttggggcgaggtggaaacggcgctagttgagccggcgccgcagcgagttgattccagagcctgcgatactagcattggcgcgggttgtgtggggtcgtacatcgacgacacgcccggattatgctaggggccccctcgtgcttaaataagaaagttgcctcttttggggctcgcactttggtaatcaaaatagcgagcgtgcgcacgggccgttgaacggctgcccgggcggtcgcgcattgatgtggactggttcgtcgggctatgcctgctgggccataagcgccggtgccctcaagagcaggttggtaaacagttaatcatcgctagaaagggcggacggcaatggcgggacagaaaatccgcatcaggcttaagtcctatgaccacgaggtcatcgaccaatcggcgaagaaaatcgtcgagacggtgacgaacgcgggcgcaacggttgttggccccgttccgctgccgactgagaagaacgtgtatgtcgtcatccgttctcctcacaagtacaaggactcccgcgagcacttcgagatgcggacgcacaagcgccttatcgacatcgtcgaccccacgcccaaggctgtggattcgctgatgcacatcgacctgcctgcggacgtcaacatcgaaatcaagctgtaagggaggagggaaccgcatgactcgcgagcaaaagaacaccaccgccttgctgggccgcaagctcggcatgtcgcaggtgtgggacgagaacggattcttcgtccccgtcaccttggtcgacgtctccaccaacgtggtgaccgccgtcaagaccgaagagagcgacggatattccgccgtgcaaatcggttacggtcagattgatccgaccaaggtaaccaagcctctggctgggcacttcgccaaggcaggggtcaccccacgccgtcatttggtcgaggtgcgcaccgaggacgccgacaagtacgagcccggtcaggagctgccggtcgacttgctgcccgaaggcagcagcatcgacgtcaccggcaccaccaagggcaagggtttcgccggcaccatcaagcgctggggcttcaagtcctaccgccgcacccacggctctcacaagaacgagcgtcgtcccggctccgtcggcgcgtgcgccacgcctagccgcattctcaagggcaagcgcatggcaggccgcatggggcacgacacgtccaccgtgcagaacctgaccatcgtctccgccgacatcgagaacggcgtcatcgcagtcaagggcgccattcccggcccccgcggctcgatcgtcgtggttcgctcgtccgtgaagggagcttgatacttatggcaagcgtcactttgaatatcaccgatgccaagggtcaggccgccggctccatcgaagccccggccgagattttcggtatccctgaggaagacgtgcaagctcacatcccgctgattcaccaagtcgtcatcggccagctggcggcggctcgtcagggcacgcacgcagtcaagaaccgctcccgcatctccggcggcggcaagaagccttggaagcaaaagggcaccggtcgcgctcgccagggctccatccgctccccacagtgggccggcggcgctgtggcccatggacccgtgccccgcgattactcgcagcgcacccccaagaagatgaaggccgcagccttgcgctacatcctgtccgaccgcacgaacgccggccgtacgcatgtggtcgatttcggcatcggcgagacgcccacgaccaagggcgcgaaggcggctctcatgcccgtcgtcggcgctcggttcacgacgattgttttctctcgcgacgaggtcaacgagtggctctccgtcaggaacctgccgaccgtccacacgctcttcgccgaccagctcaacacctacgatgtggtcaccgccgaggacgtggtcttcaccaaggcaggcttcaacgccttcctggaagccaagagcccggccgaggccgagaccgctaaggaggcctgattttcatggcagcaattcacaagccagcgcatgacatcatcattaagccggttgtttccgagaagagctacatgaacgccgaccgtggccagtacaccttcgtggtggacccgtccgcgaacaaggttgcgatcaagcaggccatcgagcagatcttcaaggtgaaggtgacctcggtcaacacgctcaaccgccagggcaagcgcacccgcacccgtgcaggcttcggccagcgcgtctcggagaagcgcgccatcgtcacggtggctgagggtcagtcgatcgatgtcttcggtaactgaaggctagccgagaaagttaaggaagaactacattatggctatccgcacatacaagccgacgaccgcgggccgtcgcaacgcttcggtttcggacttctccgagatcacgcgctccaagcccgagaagtcgctgctgcgcaagaagaacaagactggcggccgcaattcgtacggccgtatcaccagccgtcaccggggtggcggtcacaagcgccagtaccgcctgatcgacttccgtcgttgggacaaggacggcgtgccagccaaggttgccgaaatcgagtacgaccccaaccggtccgctcgcatcgccctcctgcacttcgcggacggcgagaagcgctacatcgtggcgcctgaaggcatcaagcagggtgacgcgattgagacaggcccccaggccgatatcaagcctggcaacaacctgcccctggcgaacatccccaccggtaccatcgtgcacgcgattgagctccgccccctcggcggcgcaaagatcgcccgctcggccggcgctggcgtccagttggtcgccaaggatggtgcttacgcccagctgcgtatgccctccggcgagattcgcaacgtggacgcgcgctgccgcgccacggtcggtgaggtcggtaattcggagcacgccaacgtgcagctcggcaaggccgggcgcgcccgctggctgggccgcaggccgatcacccgaggcgagtccatgaacccggtcgaccacccgcatggcggtcgtacgcgcggtggcaagccgccggtgtctccgtggggcaagggcgaagttcgcacgcgccgtccgaagaaggcttcgaacaagatgatcgtgcgccgtcggcccaatggcaagaaccgcaagtaagggagtgtcggaaagatgactcgtagcatcaagaaggggccattcgtcgacgcccacttgcagaagaaagtcgacgcgcagaatgagaagggcacgcatgaggtcatcaagacctggtcgcgccgttcgatgatcacccccgacttcatcggtcacacgttcgccgtgcacgatggtcgcaagcatgtcccggttttcgtgactgaggccatggtgggccacaagctcggggagttcgcccccacgcgcaccttcaaggggcacgtgaaggatgacaagaaagcacgccgctgaggcggaggaagagcatagacatggaagctaaagcaattgcccgtcacgtccgcgtgacgccgcgcaaggctcgccgcgtcgtcaacctcatccgaggcaagcgtgcgagtgaagccgtcacgattttgaagttcgcgccccaggacgcggccgtcccggtccgtaaggttctggagtccgcgatcgccaacgcgcgtgtcaaggcggaccgggccaacgagcccttccgcgagaacgagctggttgtccgcgagacttacgtggatgagggcgtgaccatgaagcggttccgtccccgtgcacaggggcgcgcggctcgcatcaacaagcgcaccagccatatcacggttgtcgtggccgacaaggaaggagcccgataatggggcagaagatcaacccgtttggctaccggctcggcattaccgaagagcaccgcagcaagtggttctccgactctcacaagccgggggagcgctacagcgacttcgtgcttgaggacgacaagatccgcaaggagatgaacaaggatctggagcgcgcaggcgtctccaagatcatcatcgagcgcacgcgcgaccgcgtccgcgtcgacatccacaccgcccggccgggcatcgtcatcggccgccgtggcgcggaggccgagcgcgtgcgcgccaagctggagaagattaccggcaagcaggttcagctgaacatcttcgaggtcaagaacgccgcgatcgacgcgcagctggttgctcagggcatcgccgagcagctgaccaaccgagtcaccttccgccgcgccatgcgcaaggcggagcaggacgccatgcgcgcgggggccaagggcatcaggatcaagctctccggtcgcctgggaggcgccgagatgagccgttccgagttctaccgcgagggccgtgtgcccctgcagactctgcgcgctctgattgactatggcttcttcgaggcccgcaccacctacggccgcatcggcgtcaaggtgtggatctacaagggcgatatgaccgagcgtgagttcgacgagcagcaggcccagcagggcaaccgcggccgtcgcggttccgaccgccgtccgcgccgtggtggcagcacccgcccctccgagggtcgggcccgccagcatcaggccgccgagcacgagaacagcggcatcgccacgcctcccgcccaggtcgcgcagaccgaggctgaggcgccggtcgccacggaagcaaaggagtgagctgtgcttatcccaaagagggttaactaccgcaagcagcatcgtccctcccgtaggggcatgtccaagggcggcaacgagattgccttcggcgatttcggtatccaggcattggctccgacctacctgaccaaccgccagatcgaggccgctcgtatcgccatgacccgctacatcaagcgtggcggtcgtgtgtggatcacggtcttccctgatcgcccgctgaccaagcacgccctcggttcccgaatgggttccggtaagggagcgcctgagtactgggtggcgaacgtccatcctgggcgcgtcttgttcgagatcggtggcgtgagtgaagacgtcgcccgtgaggccctgcgccgcgcgatcgacaagctccccatgaagtgcaggattatcgcgcgcgaaggcggtgacatctgatgacagtcggaacggccgaatactcaatcaagaacctgaccgagaagaccgatgcggagattgaggacttcctcaagaagtccaaggaggagctcttcaacctgcgcttccagtccgccaccggccagctggacaacacctcccgcctcaaggcagtcaagcacgacatcgccaggatgtacacagtcctgcgtgagcgcgagctcggcatcagccaggcgccggcggacggtgctgacagcagcaagagcgaagctgaggagaagtaagcatggctgacaagcaggagcgcaacttccgcaaggttcgtcgcggctacgtcgtgtccgacgggatggacaagaccatcacggtctcgatcgagcagcgctcgacccaccccctgtacggcaaggtcgtccgctcgaaccgcaaggtcaaggcccacgatgagatgaatgaggcccatgtgggcgatttcgtctcgatcatggagacccggcccctgagcaagaccaagcgttggcggctgcaagagatcgtggagcgcgccaagtaacaagttcggcaaggctccgcttgtcaccgtcccctcaccggggtatggtgcttgcggagaaccagcgcggctaaggagaatcaatgattcagcaggaatcgcggcttcgcgtcgctgacaacacgggtgctaaggagattctagccatccgcgtgctcggcgggtcgaagcgacgctatgccggcatcggcgatgtgatcgtcgcctccgtaaaggacgccatccccggcgggtcggtcaagaagggcgaggtcgtcaaggccgttgtcgtccgcaccaagaaggagcaccgtcgtcccgacggctcctacatcaagttcgacgagaacgccgcagtcattcttggcaacgggaacgagccccgcggcactcgtatcttcggaccggtcggtcgtgagctgcgcgacaggcgcttcatgaagatcgtgtccctcgcaccggaggtgatctgagatggtagccaagatcaagaccggcgaccaggtcaaggtcatccgcggcaaggatcgcggcaaggagggcaaggtcaccaagattctgcccaaggaccgtctgatcgtcgaaggcgtgcaaatcgtcaagaagcacatgaaggccacccagcagggccagcagtccggcattgtgccggtcgaggcgccgattcaccgttccaacgtgatggtgatcgaccccgagaccaagcagccgactcgagtgggcgtggtggtcaaggaggaggctcgtgacggccgcatcaagcgcgtccgtactcgcgtcgccaagaagtcaggcaaggagctgtcatgagcgatacaaccgttgaagcaccggcagtccctcgtttgaagcagaagtacaccgagcagatcgtgcccgagctggtcaagcagttcaagttcgcgaaccccatgcaggtgccgaagatcgaaaaggtcgtcgtctccatgggcgtgggtgccgccgctcgtgactccaagctgattgagggcgccatcaaggatctctccgcgatcaccggccaaaagcccaaggtgaccaaggccaagaagtccgtggcccagttccacctgcgtgaaggccaggccatcggcgcttacgtcaccctgcgtggcgagcgcatgtgggagttcctggatcgcctgctgaccgtcgccctgccccgtatccgcgatttccgcggtatctcgggcaagcagttcgatggccagggcaactacaacttcggcctgaccgagcagtccgtcttccatgagattgaccctgatcagatcgaccatcagcgtggcatggacatcactgtggtgaccaccaccaagaacgatgaggaggccagcgtgttgttgaagcagctcggtttccccttcaaggagaactgatatggcaaaaaccgctctgaggaacaaggcggcgcgcaagcctaagttcaaggtgcgtgcttacacacgctgccaggtctgcggtcgtcctcattccgtgtatcgtaagttcggcctgtgccgcatctgccttcgcaacaaggctcatgcaggcgagctgcctggtgttacgaagtcaagttggtaaagatcgacgctgaaggtccgcggcccgggcaggcaactgccgggcggcggaaaccaccgcgaggaagggcataagcccacatgacaatgacagatcctatcgcagacatgctgactcgtctgcgcaatgcgagcgcggccaagcatgagaccgtggacatgccgtattcaaagttcaaggcggccatcgcgcagattctcaagcgcgaaggttacatcgccgactttgaggccaaggaggcccgcgtgggccggaccttgcagatcacgctcaagtacggcccccacggcgagcggagcatcgaaggcatcaagcgggtgtccaagcccggcctgcggcgctacgccaagtcggactccctgcctatgcctctcggaggcctgggtgtggccatcatttcgacgagctcggggctgatgacgcaaaaggaatgcctcgaccggggcatcggcggcgaaatcgtcgcctacgtgtggtgagagaggagagctgaacatggcatcgcatattggtaagctccccgtcaccattccggctggcgtggaagtatcgttccaggggcgcgacttctcggccaaggggccgaaggggtcggactccttcactctacctgcgggcatcagtggcaaggtggacggctctgaaatcatccttgatccgatgaacgacgagcgctccaccagggccaaccacggcctgtcccgttcgatcatcgcttcgatcgtagaaggcgtctccaagggcttcgagaagcacctgctgatcgtcggcaccggctaccgcgcggtcgccaagggcaagggccttgagctctccctgggctactcgcacacggtgacggtcgacgcgcccgaaggcatcaccttcgagctgcccaacgccaacgagatcatcgtgcgtggcatcaacaagcagcgggttggccaagcagcggccaacatccgcaagctgcgcgcccctgagccttacaagggcaagggtatcaagtacgcggatgagcacatcctacgcaaggcaggaaaggctggtaagtgatatgagcgtcgcaattcgcggaaaaggcaagaaggttgcccgtctgcgccgtcactcccgcctgcgcaagcgcatccagggcacagccgagcgtccccgcctggtggttacccgttccaaccgcaacatggtcgcccagattgtggacgacacccggggcgtcaccctggtcagcgcttccacgctggctggcgacttccccaaggtcgagggcgacaaggtcgctgccgcccataaggtcggagagctgattgcccagaaggccaaggatgcgggcattaccgccgtggtctttgaccgcgggggcaacaagtatcatggtcgcgtcgcagccgttgcggaaggcgcccgtgagggaggtttggcactgtgagcgataacgagacgacgaaggagacccaagtggctggagaggcgcaaaccgcgcaggccacccgctcgggtgagactggagccagggatggcggcgaggatcgtcgaggccgccgtggcggttcccgtggcgatggccgcaggggcgatggtcggcgtgacggacgccgtggccgccgtggccgcgacgaccgcaacgacgacatgctcgacaaggtcgtaacgatcaaccgtgtgtccaaggtccacaagggcggccgtaccttcagcttcgctgccctggtggtcgtgggcgacggcaagggcacggtcggcgtgggctacggcaagtcccgcgaggtaccggcggcaatcgccaagggccagctggacgccaagaagcacatgttcaccgtcccgcgcattcgcggcacaatcacccacccggtgattggccacgatgcagccggcacggtcctcctgcggcctgcggcccccggcaccggcgttatcgccggtggcccggttcgcgccgtcatggagtgcgctggcatcaccgacatcctgaccaagtccatggggtcggccaccgctgtcaacatggtccgcgccactgtggctggtctgaagtccttggaggagcccgaggagatcgcggcccgtcgtggcctgaccttggaagaggtcgctcccgactccctgctgaaggcccgtgcagccggcatcgccgaggctcgcaaggcccgtgaggaagctaaggccaaggccgcttccgaccagaaggacggtgagtgatgagcaagcagattaaggttaccctggtcaagggtttcgccaaccagaccgagcgtcagaaggtgaatgcgcgctccctgggcctgcacaagatcggtcagagcgtcgtcctcgacgacacaccggtctaccgcggcatgatcgacaaggttcgccacctggtcactgttgaggaggcagactgattatggctagcaataactccgaacagaccgagcagccgacgattctgcgcatgcacgatttgcacccggcgcccggcgccaagcgcgatcgcatccgcgtgggacgtggtgaaggctccaagggtaagacctccggccgtggcatgaagggcacgaaggcgcgttaccaggtgcgtcctggtttcgaaggcggccagctgccgctctacatgcgcctgcccaagctgcgcggcttcaagagcccgttcaagaagcagttccaggtggtcaacctgggtcggctttccgagctcttcccccagggtggcgagattgacgccaagaccctggctgaacatggcgccgtccgcgctgggcagccagtcaaggtgctcggcgacggcgaggccaaagcggccttcgtcctgaaaggcgtgaaggtttccgcctccgccaagaccaaggtagaagccgcgggaggttcggtctcagaagactgaaccgatcggggcggctttgggaatgcggcctgatgatcggctcccaccgcaacagcgggcgggagccgatttcgtatagggacgcaagtattgacctgcccatcgtctatgatgaggcgggaagttgtcggcgcggctaggggtggccgaggcgcttatagggaggaatccaggtgaggacgttaatccaggccttcaaaaccaaagagttgaggaagaagatcctcttcgtctttggcatgatcatcatttaccggataggttccttcatacccacgcctggggttgattaccctgccgtgcagaggtgcgtctcctcagccggtaacgaggacttcataggtctggtcaaccttttctcgggaggcgcgctgctccagctgtcgatcttcgcgctgggcatcatgccttatatcaccgcgtcgatcgtggtgcagcttttgcgcgtggtgattccccgcttcgaggccctccacaaggaagggcagtccggcgaggccaagctgactgagtacactcgttatctgaccattggcctggctgtcctccaatccacgaccatcctggtcacggcccgttccggagcgctgttcaataacgcatgcacggagaaggtcatccctgacgggtccgtctggaacttcgtggtcatgattctggtcatgaccggaggcaccggcctgatcatgtggatggccgagctgattaccgacaagggcatcggcaacggcatgtccgtcctcatcttcacttccatttgctccggcttcctgccgcagctgtggaacatcggttgggggaccaacggcaaggacggtgattggaagaagttcggcatcgtcgtagcggtcctggtcgccatcctgattttcgtcaattacgtggagttggcgcagcgccgcatccccgtgcagtacacccggcgcatgatcggccgcaagatgtacggcggctcctccacttacctgccgctcaagatcaatatgtccggcgtgattccgcccatcttcgcttcctcgatcctggcaatcccaaccttggtctcacagttcggcaaggcggatcagtcatgggtcaagtggatcaacaccaacttggcgaacaccacgagcgtgtggtacatcgccctgtactcggtcatgatcgtcttcttctgcttcttctacacgtcgatcaccttcaacccggatgagactgcggacaacatgaaggagtacggcggcttcatccctggcatccgcgccggcagggccacctcccgctacctgaactacgtgatgaatcgcttgaacaccgtgggcgccatctacctgctcttcgtggcgttgattcccaccgtgcttattatgctgcttaagatcaatggcaaactgcccttcggcggcaccacgatcctgattatcgccggcgtcggcctcgacactttgcgccaggccaaggcgcagaccgagcagttccagtacaccggcttcctgctggaaggcgaccataaggaggggtgagcccctgggtacctccacatgctgtgcattgatccggtcgcggcgagctcgccaggccggatcatcattttttataagctgtagaccaatcacaccgactgacgagaaaaggatgaaagatggctcaacgactgctaatcatgggaccccagggagtaggcaaaggcacgcaggccgccctgctgagcgagcattacggcattcccgcgatttccactggcgacatcttccgctataacctgaagaacggcaccgagctgggtaagcaggcccagtcgtacatgaacaagggcgaactggtgcccgaccaactcactaacgcggtcgtggaggaccgcctgggcatggatgacgtcaagggcggttggatcctggatgggtacccgcgttccgccccccaggtggaggccttggacgccatgttggagcacctggacacgcctttgagcgctgtagtggccttggacgccgaccgagatgtgctgatggcgaggatgcagaagcgggctcagatcgaaggacgggccgacgacacccctgaggccatcgccaagcgtttggatgtatacgccaaggagaccgaacccctgctccagacctacgctgatcgcggcctgctgattaaggtcaatggcgtgggtgaaatcaacgacatcagcgcttcaatcatcgccgatctggatgcccgttcctgatctcggtgcaaatggcgagaatggccggtcgaatcgaaccacgattcaaccggccattcagttgatacggccagcggtcggactgcggaccgcgtaatgctcttgatcattatgatgaccgcgcttcagcgaggacggcggcaatcgcgattggaaagccccagaggccgtcgccggggttcgtcatggtcggcacgttcatatgggtgcctttgcatggtcgtggtaacggccttgccggtggggcaggggcagtgaagatagcggaatagcggagaagagccgagagttaggcgagtatgcgagcaaaagttgagtttgcttgactcaagtattttgctgtcggttaaaaacgggcatagtccagaccgaggccggttgtattgagtgaacggcgagggacctccccccgggtagtcattcggggcctggccgcatccgccgaagatatgaacttactgcattgcttataaggagtgtgcatgatgacaatgcttccggcgttgatgaacaattcgattttcagcgatttctttgacgatcccttcttcaataactggcgtgacagccgtcggtccgacggttcggcccagatgaccccctccgccctgatgaacacggacgtgcgggagaaggacggcaactatgagctggacattgacctgcccggcttcaccaaggacgacgtggccctgcgtctggaggatggctacctgatcgtctccgcccaaaagaagggcgagcagggctccaaggacgacgagggtaagtggattcgtcgtgagcgttacaccggcgcctgctcccgtagcttctatgtcggtgagggccttaaggaggacgacatccgcgccaggttctccgacggcactttgcatgtgtccgtgcccaaggagtcggtgcggccggtggagaccaagaagacgatctcgatcgaagactgatttcgcgtgagctttgacggttgggccgtcgacgggtctgataccccgccgacggccctttcgtctgccagcctcgcgcaaccgcgtccgtgcgacttggctcgaacaaggggcctcagcgttcagcgcagatgtaacacgccgcagaataaagggatttgagtatgctacactagcaagttggcgtgtcttgaggcgcgccgtgtaaccagccaacggacggattgaaggctcatggcaaaagacggtgtgatcgaagtcgaaggtcgagtagtggaagcgttgcctaacgcgatgttccgcgtcgagcttgagaacaagcacatcgtcctggccaccatatccggcaagatgcgcaagaactacatccgcatcctgccccaggacagggtggtgctggagatgagcccctacgacctgaaccgcggacggattacgtaccggtacaagtaaggtacaagaagcaaaggaaaaccatgaaggtcagccctagtgtgaagaggatctgcgagaactgccgcgtgatccgccgtcacggccgcgtcatggtgatctgcaccaacccgcgccacaagcagcggcaaggctgaggtagatttccagcggcataactgaagaaggcgtcaaatcacagccgtcaaggctgagccccgggtgcgcaggcctgggccgggagaccgggcgatttggtgcacgacctgcgtgaacagaaggaatcgagcatggcacgtcttgtcggagtcgacatccccaacgagaagcgcatcgagatagccctcacctacatcttcggtgtggggcgcactcgcgcgaaggaaacgcttgccgccactggagtgaatccagatacccgcgtcaaggatctcacggatgagcagctgattacgctgcgtgattacctcgagggcaattacaagattgagggagatttgcgtcgcgagatcgacgccgatattcgccggaagatccagattaattgctatcagggccagcgccaccgcaggggcctgcctgtgcggggtcagcgaaccaagaccaacgcccgtacccgcaagggtccgaagcgcaccgtcgccggaaagaagaaggcgaccaagtaagggtcgtgaaggctcggggcggtatggccccaggctggtaagccaagtaatttaatcgttggaaggaaacgaggagcaatggcagccaataagcaggccacgcgcaagcctcgtcgccgggatcgcaagtcggttcccgtcgggcaggcgcatatcaagtccacattcaacaacaccatcatctcgatcaccgacccctcgggcgcggtcgtggcatgggcttccggcggcgacgtcggtttcaagggctcccgcaagtcgaccccttacgctgccggcatggccgctgagtccgccgcccgcaaggctatggagcacggcgtcaagaaggtcgatgtcttcgtcaagggacccggttcgggccgtgaaaccgccatccgttccttgcagtccgcaggcctggaagtcggttccatctccgatgtcaccccgcaggcacacaacggtgtccgcccacccaagcgccgtcgcgtctgagcactagaaacccataagtccacccgcgaaaaccggtgagtgcaccactggttggagctgaaaggataagaacagtgcttattgcacagcgtccgacacttactgaagaggtagtcaatgcccagcgctcccggttcacgattgagcctttggagcctggtttcggctacactctcggcaactccctgcgtcgtaccctgctgagctcgattccaggtgcggccgtcacttcggtccgcatctccggtgcgctgcacgaattcaccacgcttccaggcgtggaggaggacgtgaccgagatcctgctcaatatcaagaacatcgtgctcaccagcgagtacgacgagccggtcgtcatgtacctgcgcaagtcgggtcaaggcgaggccaaggctggcgacatcacgccgcccgctggcgtcaccgtcgcgaaccctgacctgcatatcgcctccctggccgaggatggcgaactcgagattgagttcaccgtcgagcgcgggcgcggatacgtgcaggcccagctcaacaagcaggactcagacgagatcggccgaatcccggtcgattccatttactccccggtcctcaaggtctcctacaaggttgaggcgacgcgcgttgagcagcgcacagacttcgacaagctggtgctggatgtggagaccaagcccgccatttcgccgcgagatgcggtggcttccgccggttccacgcttgtggagctcttcggtctgtgccgcgacctgaacaaccaggccgagggcgtcgagatcggccccgagccggtccaggaggaggccgacccggagatggccgtgccgatcgaagacctcaacctgacgcagcgttcttacaactgcctcaagcgcgaaggcatccacacgattggcgagttggtttcacacaccgagcaagacctgctggacattcgcaacttcggcatgaagtcgattgacgaggtcaaagagaagctccaggacatggggctctcgctcaaaccatcgcccctgggcttcgacacgaacaacctcgaaggcggaaccttcttctcgcccgaggatcagtgacccttgaactagggtcaaccgtggggcgggcgccggcgagaagcaacgcccgcccccacacaagccttccggattcggatgctcgggcgaatgcccacctggattcgggagcatcataaggagaattacaatgccacaaccgaaaaagggcccgcgtctggcttccagcccggcccacgagcgtctgatgctggccaacatggccaccagcctgtacgctcacggccgtatcaccacgaccctgcctaaggccaagcgcctgcgccctctggctgagcggatgattactttcgccaagcgtggggatttggcttcgcgccgccgcgtgatgcgcgtgatccgcgacaagtccgtggtccacaagctcttcaccgagatcgctgagcagatggagcagcgcgagggtggctacacccgtatcacccgcatcgccccccgtaagggcgacaacgctccccaggcgatcatcgagctggtgaccgagcctgtgtcccctaagcaggcgacggtgcgcgaggccgaggcagccgcgaagcaggccgccaaggatgaggacaatgagatggctgaggctactgaagccgccattaccgggggtatggccgaggacgcgaccgaccaggccgtggccgcgaatgagtccggtgaggacgtcgcagccgccgaccagtccgcagtcgacctgcagaaggagtccaaggaggctgaggccgctgaagcccaggctgaagaggacgccgatgtggccgaggacgtcgctaaggccgacgagaagtaaggcgcatataaccaggcgtggctgttaggcccgcttggatggtgtgaatgggctggggattaaacccccagcccattctcgtatcctgggtgctgatgtaaggaggacgaggcatgggcggcgaacatgcggatgcgaaccacgaacctggtagcctgaccaggctgaggattgacctggcctacgagggtggagctttccacggctgggcccgccagaacggcttacgcacggtccaaggcaaagtcgaggaggccttgagccgactgctgcgcctgccgggcttgattggcccaggggtcgctggagaaagccgtggggtagaggcatttcccttcagcggcgagcggggcgcagcccgcagaggagaggaggcttggaggcccaggctcgtggtcgcaggccgcacagacaccggtgttcacgctttaggccaggtctgccacgtggacctgcctcaaaaggccctctccgctgttgtggggcatatggacgtccctgcacccgtggccttggagcgccgattgcggcatctgctacctgacgacatcgcgattcactccgtggggtatgcccccagcggtttcgacgcccgcttctccgccctggagcgcacctacatctaccgggtttgcgatgaccccgcccggttggacccccgtttacgcggcttcgtcctggccctggacggccgcctggacttggaggccatgaaccaggccgccgccgctgcgattggcttgcatgacttcggctccttcgctacgccgaacccaggtggcaccactatccgcgaggtcaaatatgcccgttgggatcgcgcgccaacccacccgctcctgtgtgaggggcaaggcccaggcgaggggccggcctacttggccccgatggccgagtcgggcctggtctgcttcacgattgtggctgatgcgttcgcccacaatatggtccgctccctggtcaacgcctgcctgaaggtcggtctgggcaagcggagggtcgactggttccagggcaaggtcgcgcaccccgagcgtgagggctcgaccggtccggcgcctgcttgcgggttgaccctggagcatgtggcctacccacctgacaaccagctggcttcgagggcccgctctatacgggccaagcgcacgctcgaggactgactcctccataccagccttgacgcccgtgggggggggtcaggccttgcgctctctggtgaaggccgacgcgccgttcgacaggtcgcctatctgtggcataatggaaaagttgccgccacggtgcagccgttggtagcaaaggatgagtgtccgagcggtctaaggagcacgcctcgaaagcgtgtgaggctaacccctccgcgagttcgaatctcgcctcatccgcctgagagagggtccggagagtattcttcggacccttttcgcgttgttggggccgagcctgcttcctgtggttggtgtgccgcgcgctcaacctgtcgtttctgtgatgtgcgtcacaacttctggcgacggcgggtgcctctaaacgttcctaagaggctcgcgggactggggtgcgtcagcgacgttcgtatcgacacggttcgatgcctgcgttgacaggggtggcgaaccgtgatttcatacgtgggcaagtacattcctaagaacccaatgttcgctccctggggatgggagcggcggcggtttccaatgaagcaaacgtcgtcgtggaggaatatccatggtagatacacaagacatgaacacaagcggagagcccgtggctccctcgtccgggaagccggccttggccactaacctcgccccagatacgggcaagccactgagcgtcggaaggaaccttcggttcgctgtgggctttgcgctggtctccatactgtgggcgctgcccttcttcatgggcgcgagcgtgctcctgccccacattttcgatggcatgaagggagtctcgcccgaaggggctattggcctggtcaattcgatcagctccatcttctccttgctggccaacatcgtgtttggcgctctctcggacatgtcccggtttaaggtgggtaagcgcacgccctggatcgtcttgggtggcgtcatcgcggcggttggctatttgctcgctttcaacacgcagagcctggccctgatcgtggttgcctggtgcgtcgtccaggtgggtctgaactgcatcatcgcccccgccgtggccgtgctctcggaccgcatcccggagctaacacgtggcaccttttccgccctctatggcgcgggagcaatcgtaggtcagcagttgggcaccttcgtcggctccttcttcttgtccaacacgcacgcgggcggcatcgtgggcaccgtcatcttcctcttctccggcatcatcgtggtccttatctggccccgtgagcagtccgccgccgagaacgccgccaaggtctccgcggccgacatcgcccgctcgttcatacctcccaccaagaactgccgggacttctacctggccctcggcgggcgtctggtgttcgtcatcggcaccttcatgatctccggctaccagctgttcatcctgcagaagtacatccatctgagccttagcgatgcccggaccggtttgcaggtcatcgccgtgattacggtcatcaccaccatcggcgcctcggcgatctccggcccgctctctgatttcctgcaccgtcgcaagatcatcgtcgccgcctccacagtgctctttgccatcggcttggctgtccccatcttcatgcccaccgtgaccggcatgtacatctacgcggccttggccggcatcgcgaacggctgctacatgtccgtggaccaggccctcaacgtggacgtactgcccaaccccgatgaggcaggcaaggacctcggcattctcaacctggccaatacactcgggcagatcctggcaccggtcttcaccaccagggtcatcgccatcaccggcgggtataagatggtcttccccgtggccatcgtgttcctgttggtgggtgccttcttcatcatgaccatccgtaaagtcaagtgatccaagtaagcagcaagtgagattcgcaggccgcccccacgtgtccgaacagctgctggaggcggcaggtggaaaggaacatcatgagtgaaccaacgcatgtgaactccagcgacctgagcttggaggaggaggcgagcctcacatcgggttcggactcctggcacgtccagggcctgcccgaccgggggcttgaggggtacatgatcaccgatgggccctatggtctgcgcaaggccaaggactcctcgtccacggacgtgtatggctccgtgcccgctacctgtttccccccgaccgctggcctggcctcgtcctggaaccctgaactgacctacaaggtgggccaggccatgggcgaggagtgcgtgcaggagaaggtcgcggtcattctgggccccggcgtcaacatcaaacgcagccccttgggcggacgcgacttcgaatactggtccgaggacccggtgctgacagggcatcaggcggccgagttggtcgagggcgtgcagtcccagggaatcggaacctcagtcaagcacttcgccgccaacaaccaggagaccgaacgcttgcgggcaagctccgacatggatgaacgcaccctgcgcgagatttaccttccggctttcgaatacatcgtcaagaaagccaagccctggaccctcatgtgcgcctacaacaggcttaacggggtctttggctccgaggacggccgactcatgaccgatatcctccgtggcgaatggggcttcgacggcatcgtcatgtcggactggggcgccgtccacaaccgcgcggccgccctcaacgcgggtctcaatctggagatgccgccctcggacagcgatgatcaggtcgtcgccgcggtcaaggccggcgaactgagcaaggaacagctcgacaagatggcccaaggcatgatcgatctgattgagaaggccaagcccgccatgtcccgtgacggctaccgctacgacgttcaggcccacaaccaggtggcccgtcaggccgcctgtgaatccgtggtcatgctcaagaacgaggacgggatcctgcccttgcgctccaacgagaagattgcggtcatcggcgagttcgccaggaccccccgttaccagggcggcgggtcttcacacatctcgccgacgatggtcactacagccttggaggccttcgagaactccagcatggaggtgagtttcgcgcccgggttcaccctggatgaggagcctcaggatgaagccctgaccaacgaggccctgcaggccgccagcaaggccgacaaggtcgtgctcttccttggcctgcccgaagaggcggagtccgagggcttcgaccgcaccagccttgacatgccggcgaagcaggtggggctgctgggcaaggtcagcgccgtcaacccgaatgtggtcgtggtcctatccaatggatccgtggtcagcctgaccgattggctgccacaggccaagggagtgctcgaggcttggctcctgggccaggctgggggtcaggccgtcgtcgacctcctgaccggacgggccaacccctcgggcaagctggcccaaaccatacccctccgtttgaacgacgaccccacagtgctgaacttccctggggaggaagggcatgtcaactatggtgagggtgtcttcgtgggttaccgctattacgacaccctcgacaagcctgtgctcttcccgttcggattcggcctctcctactctgatttcgaggtcagcggcgtgcaggtggagaagaccggcgcgaacgcggcccgcgtccatgccacggtgaccaacacctcccaggtggatggcgccgagaccttgcaggtctacgtggccccaggcaaggccaaggtcaaccgccccgcccatgagttaaaggccttcagcaaggtcttcctcaaggccggggagtccaaggccgtctcgatggacttggatgagcgcgacttcgcttattggtccaggatcatgaaggactggcatatcgaagccggcgattacggcatcgaactggcgacttcctcgcgagatatcgtccagaccgtcaccatccatatcgatggtgacggtaagactttccgcctgaatgaggaatccagcatgcaggagtgggaggaggacccgattgggtcccccatcctgagcgccaagctcaaggagctggaggcggatggcgtccatctgcccgatgatccgaacaccatggtgctgttccgcaccatgcccatggggacggtcgtcaccttctccggcgccaacggccgccaggtgatcaaggatctgatggcttcctataaggcggcattggcgaagtagccttcctggcatccacccaggcgtcctcgccggttgcgccccatcccgactgcatctcagtctggatggggcgcaaccgttatggcctcggtcccggggcgttactcgttcggggccgtcgattcctggacgaaggagagcaaggcctgaggaaaggcagggtagccctggctgagggcggtgtaagtatgggccgtagccaagagggagagggtgcgtagggtggactcatgctcgtggcaggcgggcgttgggccttcggaacggtcgtcgcgaccttggctggcggtgccgaagccgtcggcgtcctggacggtggagacagcggagcggaagacctgggtgagggagcgggcgcaattgacctccaccaccgattcggtgggcgcttccagaccgttggccgggtcggtcatggtctgtggatgcttgaggagcttctgaacggaatagacggcttgacgggggtctgcggtagggtcggccgaggccagtgtctgggcggcctcatggtggcggtcgccgaccgataggagggcttggtcgcctcctggccgccgaccggccaggaggatgagcgagaaaccggattcgtcctccgccttggcggcatcggacacctgtacggggttcaagaggcgggccgcagcgggcaggctctgtaccgcctgtgtggtcagggttcctgggtcttcgacggtggcggacaaggggctggcgggggtctgctgcgcccgggtgtgggcggtcatccacgccaaggccgagcggttgacggcttcgtcgaaacgggtggggcagcggacggtcacatcctgccaagtctgggcggccgcaaggggcaggatgattcgggcaccggcggcgctggtgaagaagggatccgcggcgcgccgggtgagcaagcgggcgtcggtccaagcgcggtcgcaggagctcaggctcaagttgtcctggtggggatccacccgctggatggcgattggggaagcgcaaccggaggctgtaacgaatacgcccaacaggagcaggaggcagcggcggaaccggcccatgctccgccgattgaggccgcctcggccgttcgctcccagcctcaatagtgtctgcatgaaaggctagaatagtatggattgcagactgcggaccgcgagcctgcgggcttacaaaagcataacttcataggaggtcttgacatggaattggacctggctgagattcatcagttagccgcagagcaaggaatagatgccgagaccttagacgagtcgcttaccgaggcgctgcgtctggcctattccaagacgccccatgccgccaagcacgcccgggtcgagcttgacgatcgcgctgggacattcaccgtctgggcccaggacgagattccccaagaacccaccgaggaagactcccaccccgcccccaagctgggagaggagtacgacgacacgccgaacgacttcggtcgggtcgccgccgccacggcgcgcggcgttctgaacgacctcttccgcgaggccgaggataagcgaatctttggggctttcgccggtcaaaaggagcacttgatcaccggtgtgattcagcaggacgccctggaccccaacaacgtacacgtggctgtcggcggagttgaggccatcctgcccaagcgcgagcaggtgccgggcgagcgctaccggcatgggcagcgcatccgcgtctacgtggtcaccgtctcgcgtggtatgaggggtccggagatcgtggtctcccgctcccatccgggcctggtgcgccgtttgttcgagctggaggtgccggagctcaactcgggggccgtctcgattatggccatcgcccgcgaggccggtgcccgtaccaagatagccgtcaaagccaacgccaagggcgtcaaccccaagggcgctctgattggcccgggcggcgcacgcgtccgcgcggtcatggagaacctgggcgaggagaaaatcgacattgtggactggtccgcagcgccggacgagttcatcgcctccgccctctcgccggccaccgtgcgcgaggtcgccatcgtatccgaacgcaatcagaccgcgatcgcgtacatccgcgattcccagctttcgctggccatcggcaaagaggggcagaacgcccgtctggccgccaagctgaccggatggaagataggcatcgagtccctggagacccatcaggccaagctcaaggagcaggaagcccaggctgcgcaggaaggtcagacggcccaggccgcgccagccgccgcgccagaggcggccgagcggacttcggatgccgcatcgcaagagtcggcagggccttccccccaaggtgaagagggctgagtcgaacatccgcaggcgcgagtatgcttaaaacagtgtccgaagtgcgcggttttaagctgcccggatgcggcaaagagacgaggtaacacggtcatggttgcacgatgatgcaggataggttcgccgtcgaaaaggagtgatcgcgccttcatacgcgcggtcggtgttaggagagaagtaagtgcccaaagcgcgcgtgtatgaattagccaaggagcttggtgtagacagcaagactgtcttgagcaagctgaaggacatgggggagttcgtcaagtccgcctcttccacagtggaggcgccggtcgttcgtcgtctcaagaacgctttcccccagcctgatcagcaggcggggaacaagaagaccaaccagcagcgcacgggaacgcccactccaggggagcaccgtgccgccgccaagcccgccgcgaagccaggcgcacctcagcagcagcccgcagcgaagcctgcgccggctccgacgcaagcccagcccaagccccaggctcaggccccggagcgccctgcgcaggctgaaagcccgagcccggcggccccccgtccagccgaccgccgtttccccgcccctggcggttcccgccgtcaaggcgcacctggggagcacgagcgccaggcgcgccctggtcagcagccccagcggcggcaggcccagacgccccgtcccggtacgcccggagcggctatgcccggcccgcgcccacagcagcctggagccaggaagggcgccaacgctccacggccgggcaacaatcccttcagccgcaagcagggtatgaggacccctacgcctggcgacatccctcgtccgcacccaatggccaggcctacagtcagcgacggcaggcgaggcggcggcaagggccgtttccgcaacggacgccccggacagggcaccggtaccggcaggccggggcagtggggtcataaccacaccggcgcatccgcaggcggcgcccgtcccggtcagaccggcggcaaccgcttcggcggcggcttccagacctccggccccgccgggcacaaccacggtcatggcggagcggcgggcgctttcgggcgtcagggaggcaagtcctccaaggcgcgtaagaaccgcatggccaaacgccatgagttcgaggagatgaaggcacccgtcatcggtggcgtgcgcatccccgcaggcaacgggcgcaccattaagctgcgccaaggcgccaccctgtccgacctggccgagaagatcaacgtcaatccggccgccctggtcactgtgctcttccacctcggcgagatggccacggccacccagtcgttggacgagaccaccttcgaggtgctgggccaggagatcggttggaacatcaagatcgtctccgctgaggaagaggaccgtgagctcctgcagcagttcgacatcgacctggactccgagaaggagggtcaggacgatcaggacctgaagccacggccgccggtggtgacggtcatgggccatgtcgaccacggcaagacccgactcctggacaccatccgcaagaccaacacgtccgcacacgaggccggcggcatcacccagcgcatcggcgcttaccaggtgaccgtcgatctggagggcgagccgcgcaagatcaccttcctggacacccccggtcacgaggccttcacggccatgcgcgcccgcggagccgagctgaccgatgtggccatcctggtggtggccgcggacgacggcgtgatgccgcagacggtcgaggccatcaaccacgccaaagcggccgacgtgccgatcgtggtggcggtcaacaagatcgatgtcgagggagccaaccccgagaaggtgcgcgggcagttgaccgaattcggccttgtctcggaggagtacggcggcgacaccatgttcgtcgatatctccgcgaagctgggcacgaatgtggacaagctcctggaagccgtgctcctgacggcggacgccgacctggacctgcgcgccaacccggacatggacgcgcgtggagccaccgtcgaggcccgtctggacaagggccgcggcgccgtcgcgaccgtgctggtccagcagggcaccctgcgcgtgggcgatgcgattgtggctggttcggcttacgggcgtgtgcgcgccatgatggacgagaacggccgctccatgaaggaagctacgccctccacgcccgtgcaggtgctagggcttacatccgtgccttcggccggtgacctgttcctggtcgcccccgaggaccgcacggcccgccagatcgccgagaagcgggaggccaccacccgcgccgctcagctggccaagcgccgcaaggtcgtctccctggagagcctgaaggagcagttcgccaagtccgaggtggacatgctgaacatcgtcatcaagggcgattcctccggctcggtcgaggccctggaggactccttgatgaagatcgaggtctccgacgaggtcggcatccaggtgatccaccgcggcgtcggcgccatcacgcagaacgacgtgaacctggcgacggtcgacaaggccgtcatcatcggcttcaacgtccgccccaaccggcaggtgcaggagctggccgatcaagagggcgtggagatcaagtactactcggtcatctaccaggcgaccgaggacatcgaggccgccctcaagggcatgctcaagcccgagtacgaggaggcgacaacctcgcactcggagatccgcgagatcttccgctcctccaagttcggcaatatcgccggagtcatggtccaggacggcacggtcaagcggggcaccaaggcccgcatctcccgcaacggggtggtcacggtcaacgagctggagatctcctccctgcgccggttcaaggacgacgtcaacgaggtctccgagggttacgaggccggcatcaacctgggcgacttcaacgacatccaggtcggtgacatcatcgagacctacgagatgcgggaagtcgagcgcaagtaagcgcccgggccctaagggcgccgatcggacagatgtacaagcgaaggacgagtaaggagaataggcgatggcctctggcagcaacccgagagcggtacgaatcgcggcactgattcaacgggtcatcgcctcatccttggaatccaagatgcacgacaagcgcctggatggggtgacgatcaccgaggtgcgggtcaccaacgacctgcaaatcgccaaggtctactggacccagataggcaagcccggccacgagcaaggcgagcgaaagcgcgcccagcaagccctgcgccaggcgaccggccgcctgcgctcgctggtgggcgccaaggccggtctgaggttgacgccgaccctgcggttcatctacgacgaggtgcccagccaggccaccgagatcgaggatgcgctcaccatcgcccagaagcgcgaccaggagctccaagcggcccgggccgacgctgaatacgccggcgaccctgacccatacaagcatgatgacgaggaagacgaggccggggacgaccccgaccgcaccgccgatgatgacgaggggcacgaccaggctggttggtccgacttggacccggagttcggccacgcccaagaggtcgaggactgaccgccaaccgctctcaagaggacggcgacccctggcggcgggcggcgaggcgaaagagacgtgggcggatgcgcagcggaatactgatagtcgataaaccccaaggggtcaccagccacgacctggtggctgcggtgcgcgcccggctggggatgcgccgcgtgggccatgccggcaccctggacccgatggcgactggggccctgattgtggggttcggccaggctacgcggctgcttaacgccatcgtggggcacgacaagacttacgaggccaccatccgcctcggtcaggccaccgacaccgacgatgcggacggcgaaccattgccggccgagccgggcgctgaggagctgctgtccgaactcacccggcaaggggtggaagcggtcatcaaggagcactataccggggacatcgagcaggtgccgaacgtctattccgctatcaaagtggacggcaagcgggcgtacgacctggcgcgcgcggggcaggacgtcaagctgaaagcccgaccagtcactatcagcgagttcgaactactgagctatgagcccacccgggcggcggacggggcggcggtcattgactgccgggctcgcgtgtcctgttcgtcaggcacctacatacgcgccctagcccgggatttaggccgggaactgggcgtcggcggtcatctgacggccctgcgccgcacccgggtggggcggttcgatttggccgacccggacatgcgcgcacgagcgctcactgcacgcgtaggggagcgcacctacacggaccggcaggggcagatcagaatccgtaagcgggccgacctggaccaggaccggctggagctgcatcggcgggctctgagcctggctgagggcgcgaaactcgccatgccgacccaaccggtgagcccaaagcaagcgcaggagctccaacacgggcggttcgtggacttgaccttatccggtcccacggcggccctgctcgctccaactgacggctgtgaagagcgtctggtggccatactggagccatatggggtgggtcgggccaagccccgcgcggtattcacccttgacgaaggctgaaaaagccacctgcccggtgagcggcgaatcgccgggcggcgagaggaaaaggacacgaatgaacgtcagcagattggaaccggataccagcgggattgtggactggcccacactgagcactagaaaacagagcgtggtgagcgtaggcgtgttcgacgggatgcaccgagggcaccgggccgtcattgagcggttggtggagctggcccacgaacagggcgactatgcggtcgtcatcatgttcgaccccagccccaagcgcgtgcactcctacgcggccacgcacggcggtgctgaactgcccgacggcgagccctcggccgatccggacgagctgatggctgcgggggagcggattcgtctgatgcgcggcctgggggtggactgggtgctgtccgtaggttactccttggccttcgcggccaaatcataccggtacttcttgggatcgctggcgggcacaatcggtatgcgcacgctagtgctcgggcaggacgcgagtatgggctcggggcgcgtgggcgacatccgcgccatccaggagctggccgaggccaccggcgtattcaggctggaagtggtggacgatgccggtcctggcctgacctggacgcccacttgtcacatccccgtcccccaaggcccgggcgagccggcggacccgctggaggggatgaacaaggctgagcggcgggcctggaccaaggctcacgcttgcaagcatgtgcgggcctggagctcctcgaacgtgcgctcgctgctggaccagggccgtattggtgccgccgatgctgtgttggggcggccgcacgtggttgagggcgaagtggtgcacggggagcagcggggccgcgcccttggctacccgaccgccaatatctcgcctgattacagcggatacatgcccgcagaaggggtgtatgcgggctggttggtggacttggggcccgccgaggaggccgagcgcgatgccaaggcagccagcggtgaccaggaccaggagcgcgtggccgtcagcagccttgaggctcggctagcccccggatcgccctggcgctggcccgccgacatttcgataggcagcaaggagactttcgctgaagacgggcggacctacgagcgggtcttggaggtcaacgccatagccggcgacgactggctggagctgtatggccaccgggtccgggtggagttcctggcctacctgcggccacaggagaagttcgccgacggggatgcgctcgccgaccagctccagcgtgacgccgctgattcgctccgtttggcgcaggaggccgccgctcgctcctaggggtcgacaccggcgggccggggaggcgatcgcggtttcttccatcccgttctgcccgtagcaccgcctggctttggggccgacagcgttgcatgcattgtgcgggggcgccgctggctttcggcaggttgtggctgtggtagtgctcgtaggcggtgtgagtgtggcggtggcggcctggatcaggcttgggcggcgagcttggctgccaggcggtccaggagtccggcgactggggaagccattggcgcgcagcttagggcttggcgggcctgggacacctgggagcgggcctgggccttggcgccttcaatcaggtccggatgggcttggagatagtccagcaccttcaaggggtcgtcggcctccaagacctgtttgaaggtgggatcggactccaagcccaggatgaccggcagggtgtagatgcggtcctggatgtcctccagcttgggcttgccggagtcgtggacaacgtcgaagtcgccgatgtcgtcgatgatttggaaggccatccccaagtgttcgccgaaagcgctggcagcggccagcagaccctcctccggctcggacgcgctcagtttgacgccggtgaggcaagccaggcggaagagggcagcggtctttccctggatggcgcgctcgtagtaagcgcgggtgacggtcaggtctcctcggcccgactcctgcaggagttcaccgcccacaatctcgcacactgtgccagcctgctcgcggatgaacgcggtagagggcgcgatcgaggccataatctccatgtagcgggacagaatcaggtcgcccaggtagatggccgccttgttgccgcggatcctgtggactgtgggctggccgcgccgcacgtccgcgccgtcgagcacgtcgtcgtggaccagcgtggccaggtggagcatctctatcgccgccgctccggtcaccagcaggctgtcagggccgaagggtcgggcgtcatcggactcttgggcacggccgaaaatcaggaccagggcggcgcgcaccatcttgccgtgattgttcaggagcctgcggtagtcctgctggtaaggctccacggaggtctcctcgcgttccagccgaccgatgacctgctgcatgtcccccttgagcagctctcgttgcctgtctgtcataagcgactcaacctctcaaacgatttgactgctcccaatatagcaaggaggagcggtgatgacccgcctgattcaccgccgaccgaccctgcttgcgcccaactgtgcctcagctcacagagaggcgggtcccggctggcggcgcccgatgaggcgctggccggccgccgcccagcgggagggaatgaagtagggtggaggcatgagcgatgcacaccgatttttgagcagccagcccggcggcgtcagcgaggacgaccgtcgcctgtctgtctccgcccggctgggacgcctgcaatttcaccgttccggcaagttccgggtcctccaattcgcggacgttcaggagggccccaaagtctccaaggacaccgtccgcctgattgccgccgcctgcgacgcggcccggcccgatctggtgattttcaccggcaaccaaatcgccggctacgactccgccttcgagaagaccttccgcaagcgccgctggtccactcgcctggactccgtgtattccaccggcctgaccatgagccggtggatgggggacgccttgcacggcttcatgaggcccaaccagtccgcagtccctggccaggcgcgcggacaggaagccgattccgccccgcgccgggagcaggagctgcgggccagtgaggacctggtgcgacagaccatcgcgcaaatcgtgcaacccctggtcgagcggggcgtgcccttcgccgtgacctacggcaaccacgacttccagtgcggtctggacaccgaccggatggacgccatctacagggagttccccggctgcttgaacccggagtccgcggcggcggcccaatccgacttgccccggtccctgccggcctccggcatgtccgaccagcgggcctatgcttgcgagcctggcaccttcgccctgcctgtcgcccccgtccaaggcgaggcgcccgtcctggggctggtcctgctggattcgggcgactacgcgcgcacgggaggctatggatcgccctcacggcggggcttggacttcctcaggcgggcgcctggcttcatcggacagcgttccatggtcttccagcacatgccgctgccccagtactaccagctgcttaaaccggtccccgcgaccacggccaacgccatccagggctaccgcgccttcgactccgcctgttacaccctggatgaggccaagaccctgcctggttcattcctgggcgagggcgtctcctgcccggaccacgacagcggtgagttcgcaattctgaaaaaggccgactatttcgccttgttcgcgggccacgaccaccgcaacggtttcgtgggctcggtggatggggtcacgctgggcgtcacgcccacctgcgggttcgcctcctacggcccggtgccggccaagcggtccgcccgcctgttcgagttcgacatccgccatccccaccagccgcgcacccagctcctggagttcggaaggcttgtcggacggcccagttccaacaaggcctacaccttcgccttaagtcatatgcccgtgtctaagggcgatgccttcgacctgctgcgtaagcccaggatcctggccggcagtctggccaccttggcggcggggctggtcgcttcgcttggatcctcaggttccggcgctgtcggagacggcgaacgcaggggacactcggaccgttaaccgcgcggtcctatgctggaagcgctctgttggagggcatcgctcaagtacttgcctgcagccatgaccagtggcgcgtagtggcggccgggggcttggctcatgcgttcgaccgggccggatatggcgattgcggccatgacttggcccgctgggttgcgaatcggggcggagattgagcacacgccctgctcatgctcgttaatcgactcagcccagccgcgtttgcgcacgtcggccagccgggaggcgctgaatttggcccgtagcaggatttgatggatacgctcgggggagtcccaagccagtagaatctgcgaggcggcgcccgcctgcatggaaagcacggcgcccacggggattgaatcacgtaagccggaggggcggtccagggcggctatgcagattcgatgctcgccctggcggcggaagatttgcgcggattcgccggtccggttcaacagggtgcgcaggatgggaccggcggcgttgaggagccggtcctcgccagcggcggctgccagctcggcgaagcgggagcccagcgtgaagcgcccgtgctcgtcgtggcagacgaagcggtgcctctccaaggcggtggccaggcggtgggccgtgggtcgggcgaggccggtggctttgacgagttgacctagtgtgatgggcccattttccagagcttccaggattttgactgttttgtcgagcactccgacgccggaatgtatgtcgccatcgtcggttgcaggctcgtctgcgtcacggtaccgcgcttcctgtacggcttcgcggagccaggtatggtcgatagctgctgcatgtgaagaatgcgccataccctgacagggtacatctcactatgtgaacgatagaagtcagttttgttactggaagcttacggtcccggggtcgtccgagcgggcgagccgtgcggagctggtgtatctttgactgggagagagaacgcgctgggcattacagcccggggtttcggcagttggggagtggatgacgggcagacacgctggatgcggcaagggtcatccccgtccggggtctcgtcgcatcctcgccaaggtgccagccgtcgcggcatctgcgcccggtcgggtcgatccgcaagccctgagccggagcgccctggccaaagtgcgggacgaggtcagctcccaggccgtcttcgtcttcctgtacatggttgccatgcagctggtcggctacgccctcggaatcatgctgatagcggtccgacaactgcctcggacgggcggcatagccttcgatcgcaccgtcgccagtctggacggttcgtccaccgccgagctctatctcttctccaccgccatcgccttcgcgttcatggtcctttaccggcgcgagcaggtcgctgatccgggaccctacggcgtcttccgtcgttccagccggtccatgaccgcgccgctcatgctgacctgcctgctcctgtccctaggcgcccaatcgctgtccatgttctacgacttcggcctgagccggaccgtcggtggcctgagagagaccaccttgaacggtctgggagcctcggccttggagaccgtgggctcgtcgcccgcctcgccgcccatgctcctatacagctgcctgtgggcgccggtggtggaggagaccgtcttccggggggccgtcctgggctccctcaaacgctacgggcgggggttcgcggtcgttacatcctccttcctgttcgcactgatgcacggcagcctctcccggtccttcttcgccttcggcctgggtctggtgctgggtttcctggcctgcgagcacagcctgatttggtcgattgccctgcacatcacctcgaacctgatcgccatcttcctgccaggcctcctgcgagagtccctggaggcccgaggtctgtcgggggctggactggagggtgggcaggcggctttctgggcgatgatagcggccctggccgccctgaccttgcttgtccagcgccgcagcttggtcgccttcctgcgctccgaacggtcggcgcccaacctctacgcctcttggggctcctactggttcctgttcgtcagtgggatccaggtggccctgattctgtggcgcctggtccattgacgcgcctgaccgcaggcgctcgcgagcgttccggaggccagtaaggggtggcgctagactgggaatcgttacatttcggagagccgcgcctgaaagactgtcggagcggatggctgcaagcacgggaaaaggggtggttatgaagcggtcgaggaaagcggccagtggacgggagcgtgccttaggccaagccgaatccagcctgactcctcagctctcaccttcccaaacctggccgtcgcaatcggccgagtcggcctcccgcagtacgaccaggcaagcgcggattaggttgaacgaccagtcgggcgcgttaatcatctacctggtggtcatgcagctgatcgggccagctgtggccgcggccctgatcgtcatcttgcagagcatgcgcaagcagatggtgtcggtcgatactgtcgtctcgcagatcgacggcaagtacgcaggggtgatgaacctcgtctgcgcggccaccgctttcgtcttctggatcgccacccacaagcgtcagatcgccgacccgggccccgacggggtcttccaccgccgtctgcgccggatgaccccctgggtgctcctgggctgcatggccctgctcctgaccggccagtccttgagcaccatctacgaccagggcttcaactgggtcatccaccgactgtctctcagggccacgacctcctccgagatgatcgaggccgcgtccggctccacggccatgttcctctatgtctccttctttggaccggtcgtcgaggaagtggttttccggggcgtgatcatgaacagcctcaagccctacggcaaggtcttcgccatcatcacttcgtcaaccatgttcgccttcttccattccgacatttcccaggggcttttcgccttctgcattgggctggtcctgggctatgtggcctgcgagtactcgattttctggtccatcctcctgcacatagcgaacaacctgctgatttccaacctgggttccatggccgtgtcgagcctgcccggccccgccaaggactgggtcgacccggtcctgttggtcggcggcctccttttgggcgccttggtcctctacctggcccgggggcgcgtccgtggcttcatcctggccaaccgcgccagcaaggggatttacgcctcctggggcggcttgtggttcattgtctacctcatcctgcaaatcctcgtcacggcaatggagttcgcgccgtctgtgtcgtgatcccccccccccccacgaggccattgagctcgggcggttgcgcccgcagttgggagctttcggctccgcgcgcattttcacggggcgcttacagtcgctgtggcacactgttccttagtggtgttatgagtatggatttcagtgtataagaggcgcgcaggccgatgtgggtccggggcgcgtgaagaggagcgggaatgacagcggtgaaccctaaggcggacgtgctgcacgtagtgggcggcaagcctttgaccggcagcatccatgtgcgcggggccaagaacttcgtctccaaggccatggtcgcggccctgctggcgcctggcgtctcgattctgaagaacgtgccggagatccgtgacgtgcaggtggtctcggacctcctgcgcctgcacggggtaagcgtggacgtggagcccgaggagggcgtggtcacgatcgacgcgacccacgtggagctggcggacgtggcggatgtggacaccctatccggttcctcccgcatcccgatcctgttctccggtcctctcctgcaccgcctgggcgaagccttcatcccggccctgggcggctgcaagatcggctcgcggcccatcgacttccacttggaaaccctgcgcaagctgggggccaaggtggacaaggagcacgaggccggcatccacatcaccgcgcccgacggcctgcatggcgcgaagatccacctgccctacccctcggtcggcgccactgagcagaccctgctggctgcggtcttggccgaaggcaagaccgagctgtccggcgctgccactgagcccgagatcatggacctggtggcggtgctgcagaagatgggcgcgcagatctccgtggatgtggaccgcacgatccgcatcgagggcgtcaagtccctgcaaggctaccggcacacctccctgcccgaccggatcgaggcggcctcctgggcctcggcggccctggccacccacggcgacatcttcgtgcgtggcgctcaccagcccgacatgatgacttacctgaacgtgttccgcaagatcggcggcgagttcgacgtgcgcgacgatggcatccgtttctggcacccgggcggtgacctgaagccggtggcgatcgagaccgacgtgcaccccgggttcatgaccgactggcaacagccgctagtggtggccatgacccaggccaagggcctgtcgatcgtgcacgagaccgtttacgagaaccgcttcggcttcaccaagcccctggtgcagatgggcgccaccatccaactctaccgggagtgcctgggttccctgccttgccgcttccagcagcgcaacttcgagcattcggctgtgattttcggccccacgccactgaccgggcaagacatcgacgtgcccgacctgcgtggcggcttcagtcatctgattgcggccctggcggcctccgggccctccgaggtgcacggcatctcgttgatcgaccggggctacgaggacttccgcgacaagctggtcgccctgggcgccgacatcgattgagactgacggcggtcccgtagcaagtccagtgattgcttgttgaaggcaggggagggcggctcgttcggggccgtcctcccttgtttgtgctcccatgcagccgagtctcctcgcagtcctgcggaaaagtgtagaaagtccactgcttgtctgcgcccgtgagctcctgggcttgccctggtgcacaatagtggcatggcatcgaaaggcaaaccctcaccgcgttcggcggtcagcccgctctcgaacgaacaggtggccaagctggcccaggcccatcggctggtggaccccacccactactacccgacagggccgcgtaaacccaacgaggccgagatcgacgagcagaaccccaaggcgacgggccgccttctggccggcgcctcccgggttgttcgcgcctcctgcaaggtgcgcgcctgggggctggagcaggtggctgagaccggccccttcattaccgccgccacccatgtcacccagttcgacgtgttcatccccatgatttcgctcttccaccaggggcgtcgcccccggtacatggctaaggccgagatggccagctggccactgataggccgctggttccgctgggtgggcatgcagccggtgccgcgcaggagcgggcaggccgagcggatcgagcgtgaatccatcaagatcgtgacctccggcaggccgctgaccatctggcctgagggcacagtgacccgtgaccccctcaagtggcccatgtccctgaaacccggcgttggggtcatagccctcaaatcctcgcgaatactgggtcgacaggtgcccctcttcccttgcgtgacctggggggccgcctcaatcaaccactggtggccgtggccccgcaaaaacgtggtcatgtgctacgacaaggccctggactactccgacctactggaaggcatggaggactggggggaggagccgccgcgtgaggcggtggacgagctgtgccgtcgtctgcgcgatcggatggaagccgtcatgagcgagatccggggcgaggacccgccggtcgaaggctacttcgactatgggagcatgacgcgcaagcccagagcataagggcctggcggctctgtgccgcgtgcgccctcaaggattggtctgcccccgggtggtgacggtccctgacggtctcggttcggcgcaacttgaaggccgtatgggcgcaagtctaggatgggtgtgtttgaacgcatccagaatcggcaaacagttggtcaggtggcattgatgccaacccggccaggcacaaggagcggtatgacgaagattgcggtcttaggagccggagcgtggggcaccaccttcgggcaggtgctggcggacgcgggcaaccaggtggtcatgtggggcattgagcctgcagtggtggacgccatcaaccatgaccatcgcaaccccgtacgtacgccgaccatagagcgtctgccggatgccatgaccgccagcctggaccgggaggaggccgtggacggcgccggaatcgtagtcgtggccatcgcggcccagcacgcccgcgaggccctggagcccttccggcccctaatcggagcggacgccgtcgtcgtctccctgatgaaaggcatcgagcggacgaccgacaagcgcatggaccaggtggtcaccgaagccctggggctgccggaagagcggttcgccgccgtctccgggcccaacctgagtcgggaggtggccgtccgccaaccttcggccgcagtggtcgcctcagtgagccccgaaaccgcgcagcgcgtggctcaagcctgtgaagcgccgtatttcaagccgttcgtgtccaccgatgtcatcgggctggagctgtgcggggccttgaagaacgtgaccgcgctcgctgtcggcatgtcgcgcggggcaggctacggcgagaacaccgccgccatgatccaagcccgtgggctggccgagttgaccgcactgggcgaggcggccggtgccgatgccaagaccttcgccgggctggccggcgtgggggacctgatcgccacttgtgcctcatccctgagccgcaactacaccttcggattcaatctgggccgtgggatgagcatcgaggaggccaccgaggccagccagggcgtggctgagggcgtgcccgccacgaacgcggtggtaggcatgggccggagcctgggcgagccgacgccgctggctcaggccatgagccatgtgttggaccagggcctggactgcgcgggaatgatcgaggaactgttcggtggtccgatttcggccgaatgagcctggtggggatggtccgtccctggttccgctgattgcgccgcgcgggcttgagccgaaccgccgccgggccatgccggggcctatcctggcaagtaagggaacgcctgcgggcgcagcgggcgcgcgattgcgcatgcgctgattcgcgggccaaggaatctaaggaatgagaagcgatatggcgagtaagcggcgggtggcggtactgtacggtggccgggcggatgagcaccctatttcctgcgtttccgcagccggggtcctcaatgccatagatcgcgaccggttcgagccggcgccgattggcatcacccgtgatggcgtgtggaccgtcggtggtgaagacccgcgccagtggaacctgggcggccctgagctgcccgaggtgctcgtacgtgagaccagccggccggtcctgctcgacatcgccgagggggccgacggcttctatgccggcgcccacgaagaccttgaggccgcctcgcgggcttcgcgcccgccggtcctgggttcgggcgcgaatggccggtccctggagcccctggggcacatcgacgcggtctttcccgtcctgcacggtcccttcggcgaggacggtacggtccagggtcttctggacatgatgggcctaccgtacatcggttgcggcgtcttcgcttcgtccgcctgcatggacaagcacttcacgaagatcctgctgcgcgcggcgggcattcctgtcgcgcccggcatcaccgtggattctcgcaccctggcagggggcgagtccattgaggcggccggcgacgagctggtcggcctggtgcgcgaggccaacttgacctaccctgtcttcgtcaagccttccagggccggctcttccttcggggtgaccaaggtggagcatgagaatgccaaggacctggcccgggcgctctttgaggcttcgcgccacgactggcgcgtcctgatcgagcaggggattgaggcccgcgagatcgagtgcgcggtcctgaacccggttgacggcgaagagccatggaccgcctggcccggtgagatcgtgcttgacaagcccgccgatgacgcgttctacgacttcgacagcaagtacatggatgcggccgcatcgcatgtcgaagtgccggccaagttggatgaggacgtgctccagcgggtgaggcggacagctgcgcgcgccttcaaggctgtggatgggcgggggctgagccgggtggactgcttcgtgctgcccgacggccaagtcctggtcaacgagatcaacaccatgcccggtttcacgccgatttccatgtaccccaaggcgtgggaagccacgggcgtctcctacacagacctgattacccaactcatcgagggtgtcctgcaataggtcggctcgcctgtcaaggaaggctctcgtcggcaactttggaagagcggtgttctaggctatccctttacagggatggctgctgagtgaagcgttgatgcttgttttggcatgtttgctttaccggctctgagttggtgatgtctggattcgcgtgttgggtttttacactctagttgattcgctctgttttgggcgtgctgttggcgggattggttgctcagcaagggaactgcttattgcttcacaacgaatcccgccaacagcacgtttcgcatcgcgggcttgaatatacctaacctcaaggttgcgtgtgatgaaggcggagtgtatgtgggctttggcgctgtttacgggccttcgagagctggtagcctgcgagagtgacccctgcgagacaagtgaaggcgatgaacgttgttccgatgagcccgtggaaggggatactgccggctcgggggagggtgtagggaatgtagatgtaggtgaaatcgtggatggggtagtcggtttgcgctacgccatccaaggtccaggtgacgatgacggggactgggcctcccgagtcgtatctgggcgaggtgacgttccaggtgctggcaccgtcgttgggtgtggggccgctttgggctggagcagtaccgaacttgacggcagtgatgttgatgttgtagaacatgcctgtgctcacgggggtgaggcttattttgcctggcccgccttgcttatcgccgagttgtccgtattggttgtctccccaggtccagactccaccggtggtgtctactccgatggtgtgtttccaaccggagaggagtttggcgaacgtggtaccgggcttagggttaaccacgatgggccgggttggggtggtttggctaccggtaccaagttggccggaggcgttgtcgccccatgcgtagatgctcccgttgctggcgatgctcatggcgctgtcgctgctggtggtcacgctggtgaaggtgataccagcgggtagggtcggttcggctggtagttgctgatttgtggtggtgccgttgccgagctcgtagtcgttgttgtacccccacgtgtaaatgcgcccagtgtcgctgatagcgagtgaccaatccgcggtagcggtggcctgcttgaaggtgctcacgccaacgggtagttgcacttgtacgggcacggcgctgctgccgcccacgttgatgacactggttcccagttgtccgaattggttggacccccaactataagcctgcccgttatctccgatgccgatggagtgcccggcggcagcactgacttgggtgaactggtagacgccagctggcatctgcaccgctaccggactgagctggttaatggtggtattgtcgccaagctgtccgctgttgttggctccccacgcataggtggtaccgttgtcgcctatggcgagagtatggtctacgcctggactgacctgcctgtacgcgcccacgccagcaggcatgctgatcggcagaggttgcaactggttattagtggtcccgagacccaattgaccactcgtattaaacccccacgcgtaccagcggttatcgctacccagtgcgaacgagttgttagggcctgcactgactttcaggaacttcaccccgtttggcgtgactgccttcgtgggttgcagccggctggtgatgctgttgtccccaagctgcccggcatcgttttccccccacgcgtacaggtcaccatcagagccgatagcgagtgtgtgataccaacctgctgatacttgggtaaactgcacacttgacgttgcaggatgcggggtgatggtgacactggtgccaccactgttaggccctcgattcgggtccatcgtgaacgtgaaggctggtttttcccaacgagcggtcaaggtaatgttgctcgtgactggctcgttaaacgtgtagggcttgttgtcgaggaaccagcccacaaaccgatgcccattccaggatggttgcgttggccatgctgctttcgagttttcctccacgtgctgaggacttggcgtgctaccaggagcggcacccaggttaaaactgacagtaaacgtatccaagtaatggtacttcaatgtctcattcggttgcgcaacctcattcaaggtccaactcactaccacatccacatcccccggagcatggggcggggtgttccctgtccaaatactcgacacatcagtcaccgtacccggcgtagcgatacccccaaacgtaacccgagtaatcctaatcggcccacccacacgtaccggagtactgctattggtggtgctaccgtcgccgagattcgcgagttcaccaagtccccagctgtaggtgttgccgtcgctaccaatagcgaaagagttccagtagccggctgtgacactgacaaaggttactcctactggtacttgcaccgtaactggtgttgtaacattttctgagctgttgttgccgagttcagtatagtagttgcttccccatgcgtatgttttgtggtcgcttcctataacgagggtgtgccagccgttgctgctgcgttgtacgatatgcactccagctggcatgcgaagtgtgaccagtgttggcgtgtgtttttcggctgtgggctcgcttggataggttgaggttccgtccccatactggccacctatgcgattggctccccatgcgtagttgttgccgtcattagtggtagcgaaggctgtgtatccgcctgcggtgatgctagtccatcgaaggccgttaggagggtttaccggaaaggcggaagtgcggttagtggtgtcaccggtgcctagctgaccatattcgttgtctccccaggtgtagatgacgccattgtcgcctagtgccatgctgaaataggcagctgcgctgatgctaataatgcgaactgtgcccggaatgccagcaaccagcgtggggctggaacgcattaccgtatcaccaactccaagctggccaccgcccgaaacgttgttaatcgatgtatcgttgcagccccacgcgtagactttgccgttgtcgccgatagcgaggttgaagtcggccccggcattgatttgggtgaatcggttcacgcctgcgggtagtggctgtattttggtgggaataaggcggttgttagtatctcctaaacccgattggcccctattattcaggccccaagtgtagatatagccatcggtgcctagagctatcgaatgtccgtaaaagcctgcgcttatttcggtgaatttgatgcctgctggtgtttgtatgcgcacgggtgcgagtcgttgagtgttggtgtcgtcgcccagctggccgtactggttgtctccccaggcgtaagcgttgccatcatcgccgagagccagcgtgtgatagtaaccagaactaatagttgtgaatttcacgccacctatggtgtaggggttgatggtagcccttgtgcctccggcggcagggcctgatttaggggacagccggaagtggttggaggtttcgtcagcgcgcactggagtgggatggatcagtgaactagctgctcccccccccccccaggacaatcatggagataagcgccagtatggcgcttgctgtgcgaaaccgtcgcataattgcactcctcaaaccgtatgtagtgcccggtggccccatttaagtttcttgcgcgcctaatcgcaggcttgccgttccccaatcgcctacgcgcttgacacgaaccccaatttcctgaagccagtttaccatcattcgcgcaaaagatagctcaaacccttgcagtttaggacacagtccaggttgctgccttgcgattcgggctgtctgagctggcggtggttggcactgatgcggtctgtgccgggcgtgtgggtccggcgctggctggtgtgtgtgggtcgagcgctgacggtgattgtgatcgggtggggtgcggtccggcccattttggggtgggccggaccgcaggccttgggatcaatcacctgccgctggtggttgttgtggtggtggtgggttggtgggtgtggtggtgtttgcgggtgatgtggtggctggtgagggtgagggcggtgagggtggtgagggtgaggagggtggctcccgcgagttgttgggtgggggcgccgcctgctttgggcagggtgtagtagtgggtgtagtcgtaggtgagggtgtagtcgggttgggtggcgccgtcgagggtccagtggatggtgacggtggcttgtccttcggggtgggttgggctggtggtgtcccaggtgtgggtggtggggttccaggtgggtgtgggggcgttggtgggctcgaaggtggtgccggtgatggtgatggcgcgtgtggttggggtgggggtgtgtcgttcggtggtggtggtgtcgccgagttggccgtagccgttggctccccagctgtaggcgtgcccgtccgtcgcgatggcgaggctgtgccagccgccggcgctgatggcggtccaggtggcggtgccgtcggcggccgggctggcgggcgcgggcgtgttgcggtcgctgctgccgccgtcgccgagctggccgttgctgttccatccccagctgtaggcgtggccgtcgccgctgatggcgaggctgtgccagccgcctgcgctgatggcggtccaggtgtcggtggggttgccgctggcgggggcgtggacgggcgcgggcgtgttgcggtcgctgctgccgccgtcgccgagttggccgtttctgttccatccccagctgtaggcgtgcccgtccgtcgcgatggcgaggctgtggttggagcctgcgctgatggttttccacgtgttggcggggttgccgctgtcgggcgcgtggacgggcgcgggcgtgttgcggtcgctgctgccgccgtcgccgagctggccgtttctgttccatccccagctgtaggcgtgcccgtccgtcgcgatggcgaggctgtggtagttgcctgcgctgatggttttccacgtgttggcggggttgccgctgtcgggcgcgtggacgggcgcgggcgtgttgcggtcgctgctgccgccgtcgccgagctggccgttgctgttgcgcccccagctgtaggcgtgcccgtccgtcgcgatggcgaggctgtggtagtagccggcgctgatggttttccacgtgttggcggggttgccgctggcgggggcgtggacgggcgcgggcgtgttgcggtcgctgctgccgccgtcgccgagctggccgttgctgttgcgcccccagctgtaggcgtggccgtcgctgctgatggcgaggctgtggtagttgcctgcgctgacgctggtgaaccgcacgcctgggggcgtgttcacgcgtacgggcgcgctgctgtcgttggtggtgccgtcgccgagctggccgttgaagttgtacccccaggcgtaggtgttgccgtcggtgccgatggccaggctgtggtaggtgctggcgctgacctgggtgaaccgcaggggccgcggcgggtcggggggcgtgatgtggacggtggtgccgccggtgtccgggccccgggtgggggtcatggtgaattgcggggtcctccatttggcggtcagggtcatgttggaagtgacgggcgtgttgaagttccacaggctgccgtcgggtttggcccacccgtcgaaccagtggcccgcccaggccgggtcgggctcggggtaggtgatgggccgcgggtcgtccgggtacgagtactggctggcgggcgcctggctggtggtgtgcccggcggcgtcgcccagttggaagctgacggtgtacgctgtggcgtacgtgtagttcagggtgaccgtgccggactggtagttggggctggcgaccctgccgttcacgtcgaggccgtcgagatggtaggcgacggtcacgtcgacggcgcccggggtatgctggggcacgtgcatgtcccgcgcgccggtggtggcgttgacggtcttactggcgacgcttgccccgccgaaggtgacgttgtcgatcacataccggggcgtgagcatcgtcgcgggcttgctgtgggggttggtggtgccgtcgcccagcttgccgtattcgttgtatccccagctgtaggcgtggccgtccgagtcgagggccaggctgtcatagtaggctgcgctgatttgggtgaagcgcgcgccggctggcgcgtgcacgagcaccggtttgctgctgttgctagtggtttcgtcgcccagctggctgagcatgttgtttccccatgcgtaggtgttgccgtccgatccgatggccaggctgtggtagaagcctgcgctgatttgggtgaagcgcgcgccggctggcgtgtgcacgcgcaccggtttgttgctgtcgctaccggtttcgtcgcccagctggccgtaagtgttgtatccccatgcgtaggtgttgccgtccgatccgatggccaggctgtggtagtagcctgcgctgatttgggtgaagcgcgcgccggctggcgtgtgcacgcgcaccggtttgttgctgtcgctaccggtttcgtcgcccagctggcggaacacgttgcttccccatgcgtaggtgttgccgtccgatccgatggccaggctgtgccagttgcctgcgctgatttgggtgaagcgcacgccggctggcgcgtgcacgcgcaccggtttgctgctgtcgctaggggtttcgtcgcccagcttgccgtagctgttgcttccccaagcgtaggtgttgccgtcggagccgatggcgaggctgtgatcgttgcctgcgctgatttgggtgaaggtcacgccggttggcgcgtgcacgcgcaccggtttgctgctgtcgccaccggtttcgtcgcccagctgaccggagtcgttgcttccccaggcgtaggtgttgccgtccgagccgatggccaggctgtactcgtagcctgcgctgatttgggtgaagcgcacgccggctggcgcgtgcactcgcgtgggcgtgctgtgggtgctgcggtcggtggcggtgtcgtcgcctaactggccaacgaggttgcctccccatgcgtaggtgttgccgtccgagccgatggccaggttatgccagcagcctgcgctgattcgggtgaagcgcaggttggttggcggggctggtggtgtgagtgtggcggtggcgtcttggttggcggggcctttggtgggggtgagggtgaagccgttcacggtttgcgaggcgggggctcctgatcgggtcaggtggttgggttcagcgtgggcgggccgggccgccgcgttgccccccaggaggatcatggccagggccgcgaatgcggcgctggcggcgcggaaacgactcattgccccctccaaaacaggctggcggaagagcgcacagatgcgcgctcttccatgaaaaagtgtgttgttggtattcgggtggtgcgcggcagaacaaaactctccagccagttcagggcagcaaaacccattttctgattattaagtttagcacaactgtggcgggttgaggcaaagtggcggtggcgtcttggttggcatgcccgctggtggggtggacggcgcctgcctgccgctgcccctgaacatgatgggcacgatgatggggttctcggcctcaagcaagtttacgccccgtcagatccaaggagcgcagcaagccgtcctgcaccgttgctccaggctcaatagctgcgggaattacgcgctgcgggagtcggtgtagtcgtgggtgaggagcgaagcgcctgatgcgctccggggcatgtccgagaacatgattggctgcgttacttatcgctttgtgtgttaaaaaggtgacttgaagagtccttatgaatcgaatatttgatgttacagtagaatatatggataaataagctcaatatagagcataattatagtgctcctataattagtggaatgggtagagaggtgagactatggcggatgcttacaggtcattggcgagggagtaccacgccgataggtcggcgaatatcctgtcgaatcacaaagagctcgagcgccagcggttggagtccacctcctccttccgtacgggcatagaaacgagctttggtgagctcttcgtggccatgtcgcgcgatttggtgctcaagcttgaggacgttctgacgacagacaagcggatcgccttgatgtggaaggacgcctatcccgagttccgcgactcgtacatagaggaggcaatttccgacgagctgctgaacaccaacctgatggagggggtgcgcagcacccgcaaagagaccaaagccgcggtggaggccatctacggcgcccgtaagggttccgcgaccccgcggttcggcgagttcgccaggctctacaaggagctggtgaacagcgccgataccgattcccgcactgaccgcacgaagatgccgaaggacttggctgatattcgccgggtctacgacgccatcgcccttgacggggtgcccgatgcggacaaacccgacggagagctctttcgcaaaggaagcgtcgagatagaggggccccggggtgtggagcatgcaggcgtgtccggcgaggtcaatatcggcgcgatgctgatgcaaatgctgggactggtcttttcgcgcgagattccgcacataccggcagtcatcatgtcccacttcctctttgagtacatccaccccttctatgacggcaatgggcggacaggccgctacctgctgtccctgtacctcaacgaggatttgtccttgcctgtcgtgctctctctgtcgcgggtcatggcggagcacagaagcgagtactaccaggcgtttcgcgaagcccaggataagttgaactgcggcgagctcacccagttcgtaatcaccttcctcgggttcatccaagaagcccaggatgatttcatgaaggcctttggcaggcagcttgaagagaggacccagatttcccccctgtgcgaaagtatcgggagggagaggggcttgacgggtccggccacccgcatccttgagagcgtcttcagggaggcggttctgggcacgcgcaagggtgtcggcttaggcgatttgtctcaggagctcgggcgcagcaagcagagcgtcagaatccatgtcggcgagctcctggaaaaggggctcgccgtgtacaccaagcgcaggcctttgatgataacggtttcacacgccgccctgggccgcttttacgcgcaaggctagtcggcgctgtcttggaccaggtagggctggttggagagggctcgggtggcggcgtcctgcatgtcgctggcggctacgcccggtttggcgaacatgaccacctggcccgtcgccccgtacggggagaagccctggaactggacgacgggcggcttgccgggcagcatcatggcgctggtggcggtctcgacccgttgggcgattgactgggcgcaacggtccaggtcctggccgccgcgcaccgtgaaggagaccgtggccgctgattcgctcaggggcgggatcttctccagggcggtggtgttgagcaccgaattgggaatccacatctggttgccggtgcgatcggccacgatcgtgtgccgccaggtgatgtcttccaccgtgccggtgatgccctggatggagatgatgtcgccaggctgaatcaccttgctgagcatcaggccgaagccgcccacgatgttcgcgatcgtgtccttcaagcccagcgacagggccaaaccggagacgccaagggccgtggccaccgtcgtcggattgatgccgaagaccggctgcaacacgcaggccgccgcgaaaatccagatgaccgccttgacgatgttgacgaaaatcgacgccgatgggatgaccgtgtgctccaaggtgcgcttcatgaccaccgagacgcagcgggaggccagggctgcgcagatgatgacgatggccagcaggacgatgtgcccgaagttgcgctccagccaggtctgcgccaggttagcggtctgttcggccttctgctcggcgcccgccgccagcaaccagttcatgccaattccccctgccctcgccctggttcttgcccttgcctgtgctcggcccgcccggcgctcccgccgcccaggcgcttgctcatccacatgtgcgggcagccttcgtccaaatcgcgcaagccggtcggctcatagccgagactgcggtagaaaccctccgcctgctcctgggcgtggaggagcacccgctcgcccccgtgcccggtgatcgcggcttcggccgcggtcagcagggccgcgcccacatggttgccacggtggtctttgagcacggcgaggcggcctatggtgtactgccttgagcgtccgccggcgtcgaaccggccctgcgggtcgctggggaagaaccggcaggtggcgatggcctcccgcctggcggggtcgccctgttcgccgcccgcgagtccgtctgcatcggcgaaggccagcatgtgggtgctcaggtcgtcgagcgcgtcgaattcgtcgtggaagccctgctctcgcatgaagacgagctcgcggatgcggcgggcctggtccggcagccttcggtaggtctgcgtgcgcatgtcggtcttctttcgggtgggagcgtgcctgttctgccattctaatctgaaccgcaccatcaggcatgaaagcctcctgggcgcaggctggacgcttccgcgtcagcgctcgcggctttgcccgctgcgctggccaaggtgaccgataaggtgatgcatgacgattgtcgactactcgaaggggcgctcatggcagccgatacgatgaaccaagccaaccagcgggacgcgcgcggagagcgcgagcggatgctggccggggagccctacaacgccgctgaccccggactgtccgccatgcgcgccaaggcccacgagctctgccggcgctacaacgcgctgtctgaggccgccagccaggagcgcgaggccatcatgaaggaactggtgggcggcataggcgcggacagcgagatcctggggccggtcttctttgactacggcgtattcacgaccataggggagcgggtcttcgccaacttcaacttcagcgtgctggacgtgtgcccggtcacgatcggcagcaacgtgatgttcgggccgaacgtctccctgatgacgcccctgcaccccctgtgctgggaggaccgaaacctgcgtgaggccgagtccggcgagctcttcgactacgagtacggcgcccccatcacaatcggatccaactgctggctggccgcgaatgtgactgtgaccggcggcgtcacgattggcgaaggctccgtcatcggcgccggctcggtcgtcacccacgacatcccgccccactccctggcctatggcaccccctgccgtgtcgcccgccagctgactgaggcggaccgtatggccctccccacccggttccccgagcgctcctagtcgcacggcttcgtttccgccgctcgcattggaaagcgtgggggcgtagtgacctgcgaatcgcactatgtgtagagtgtgtgtaatagtatcttctacccaaaatagttttgggtagaagatactctgtatgggagcgggcggccaaattggtcggtccagcggctggtaccggcaggcgccagggtcaggaggcgaactgatgtcctatgccgaggaagccttcgatgagctctcgcgcctggtcatggagcaccgggccgtcgtgccggagaaggtggaccggtccatccgtggggaagccgtcatcttgcgggccttggagaagttcgggagactgacgccttcgcaactgtgtaaagtcgcccggctcagctcggggcgggtctcctcgctcttgcgctcgctggagggcaagggctgcgtcagccggactgccgacgacgaggaccgccgcaacgtgcatgtctcaatcaccgaggtcggcagggagcgtaaccgtcaggcctacggcatgatgagacgagacatatgctgggtttttgggcagatgggacaggcgcaagccagcgagttcctgaggttgtgcgccctcttcgacaggtatgtggctgagcgctgcgaaagccgcataagccaagccggccggaggcggcctgtgccctgatgggcggacgtaagcagggccttgcgccccaagccgtcgcacctttttcgtgacaacaaaacccggggtccttgaccccacctatgagaagacgtactgccaacagttggtcgaaccggttcgagtcctgttcgcgcggggcgacgagcgggctgacgcggcgcaggcgaccagtaagtggacgcttagataagcagaaagaagcagcatgatacgaatctgtcgatacctgtccaaggcggagctgggccagctggtcctggtggtcggcttcatcgtggcccaggtctggctggacctgaagctgccggactatatggccgacatcacccgccaagtcgagactccgggaagccagatgagcgagatttggaagtccggaggcaagatgctcctggtctcgctgctctccctggtgtgcgcggtattgacctcctacttcgctgtgcgcgtggcctcctccttctcccagcgcttgcgctcgctggagttcgccaaggtggagtccttctccacagccgagatgggccgtttctccaccgcctcgctgatcacgcgctccaccaacgacgtgacccaggtgcagatgttcatcaccatgggtctgatgatgctgatcaaggcgccgatcatggccgtgtgggcggtctgcaagatcgcgggcaagggctatgagtggactatggccaccggcatctccgtggtcatcctgctggtcgtcgtcgggctgctgatggtcttcgtcatgcctaggttcaagcggatgcagtccctgaccgacaacatcaaccaggtggcccgcgagaacctgaccggcctgaaagtcgtgcgcgcctacaacgcggaggactaccaagaggataagttcacccgggccaacgacgagctgaccggcacccagctttccaccacacgcgccatgagcatcatgatgccggtgatgaacacgatcatgaacgggctgatgctggcggtctactggatcggcgcctacctgatcaacgccgccggaatgatggaccgtatcaccctgttcggcaacatggtggtcttctcctcctacgcggtgcaggtcatcatgtccttcctgctgatgagcatggtcttcgtcctgtggcctagggccgacgtctccgcccaccgcatcatggaggtcctggacaccaggccctcgatcgccgacggccagcaggcctccggcaagccgggcgagcgcgggcaggtgaccttccgcgacgtgtccttcacctatccgggagcctcggcccccatcctggagcacgtggacttctcggtggggcaggggcggaccgtggccttcatcggctccaccggctcaggcaaatccaccctggttaacctggtgccccgcttcgccgacgtctccagcgggcaggtcctggtcgacggagtggatgtgcgcgactaccaggtcaaggccctgcgcgacaagatcggctacgtgccccagcagtccttcatgttccgcggcaccgtcgagtccaacgtggcttacggcgaccaggccgacggcgtgagcgagcaggagaagctggagcgggtcaagcaggccgtgggtgtggcccaggccgaggagttcgtctcgggcatgcccgacacctaccggtcggccatctcgcaagggggctccaatgtctccggcgggcagaagcagcgcctctcgatagcccgggccgtgtggcgcaagccggagatcctgatcttcgacgactccttctccgctctggacttcaagaccgaccgccaggtgcgcgacgccctgaaggaccagatgaagggggccacgatgatgatcgtggcccagcgcatcggcacgatcatggacgccgaccaaatcctggtcctggaccagggcagggtggtgggcaagggcacccaccaggagctcctgaagacctgcccggtctaccagcagatcgccaagagccagctgaccgaaaaggagctggccgcatgatccggtccttacagggccttggcgccccggcggccggagccgcggtagttgcagagttcgctatggcgaggagtttgaggacacgatgagtacagcacagcgttcgatggccgccaggccgtccaggggcggccacggccagatgcgcggtcgcatggagaaacctgagagcttcgggcaggccatgaagcagttggggcgcttctccaagcgatacatcccagccgtgattgtggctttcgctttcggcgcggtgggcgcggcctgccagatcgtgggccccgactggcttaagagggtgaccgatgccatcgctaagggcatgccggccatcgtccacgggcgccccgtcatggcctcgatcgacctgggctatgtggagcgcgtctgcttcgtgctcgtgggcctgtacgtgggctacgccttgttgacctatgtgcagtcctggatcatggccacgctcacccagcgcaccgcccagggcctgcgcgaggccatctcgaagaagatcaaccgtctgcccctcaggtacttcgacagggtctcctacggagacgtgctctcacggatcaccaacgacgtggacgctatcggccagaccctgggccagagcctgggttccttggtgatctcaatcactacgttcgtgggctcgttgatcatgatgttcgccaacgacgtgatcatgaccgtggtggcgattgggtcggcggtcgtgggcggcatcctgatgatggccatcatgggggtctcccagaagtacttcgtgcgccagcagatcgccctgggcgacgtgaacggccacgtggaggagaagtactcgggccacgtgatcgtcaaggcgtactcgggcgagcgggattcgatcgagcagttcgagcggtacaaccaggacctgtacgagtcgggctggaagtcccagttcctctcctcgctgatgatgccgctgatgaacttcgtcggcaacttcggctacgtggccgtatgcgtggtcggcgcctcactcgccatgaacggcaagatatccttcggcgtgatcgtggccttcatgatgtacatccgcctgttcacgcagcccctgagccagttcgcgcaagccttccagaacctccagcgcaccgcggccgcatccgagcgcgtcttcggcttcctggacgcacccgagatggccgacgagtccgacaagcgggccctgctgggtcggtcggcggatggaagccccaagccggtgcgcgggcaattggacttcgagcacgtgaacttctcctataagccggatcatccgatcatcaaggacttcaccgctcaggcccagccagggcagaaggtggccctggtcgggccgacaggcgctggcaagaccacgatggtgaacctgttgatgcgcttctatgagctggattccggcgacatccgcatcgacggggtctccaccgaggatgtgccccgctggaacgtccacgaccagttctccatggtcctgcaggacacctgggtcttccgcggcacggtcaaggagaacgtgatttactccaagcagggggtcaccgacgaacaggtggtctccgcctgccaggccgtagggttggaccgtttcatccgcaccctgccccagggctacgacacggtgctgaccgacgacacctcgctctcccaaggccagcggcagttgctgaccatcgcccgggccatggtccaggacgcgccgattctgatccttgacgaggccacatcctcggtggatacccgaactgaggagttgatccagaaggccatggacgcgctgaccgtgggccggaccagcgtggttatcgcccaccgcctgtcgaccatccgcgacgccgacctgattctggtaatggaccacggccgaatcatcgagcggggcacccacgagcagctgcttaagcagggcggcttctacgccgacctctataacagccagttcgcttcaaccgagctcctggcctagggcggctggcgcgacaggccgcgcggggcgcttgccggtcgctcgcggatatggtatcttagacaagttgtgtgtttgagcgggtgcttgcagccgccggcccagcgcacggtaggacttggaagaacgacgtcaaagggagtcatcatggcagctcgttgcgcagtgtgcggcaaaggcccgcgctctggttacagtgtttcacattcgcatatccgcaataagcgcgtcttccgccccaacctgcagtccgtgcacacccagatcgacggcgagaacgtgcgcgtccgcgtgtgcgtcaagtgcatcaaggctggtaaggtgcagcgggtcgcggcctgacccatccggcggaagtcggctgtttttcggacctcccagggcttaggccctggaggtctttttcgtattcggcctccgggtcttccggtagagtcggaagggcagggaggaggagccatggagaaaggtccggctgtcagcctggatagcgcggtctctgcgctactgcccaacaaacggcgggtcagcgcgctcaaatccctgggaatcacgaccgtgggggaggctctgacctactaccctttccgggtgagcgagccagtgccggtgctgccgattcggtccgtgcgcctgggctcaccagtggccttcgcggcccgggtgaagtgggcgcgggtggtgcctatgggaagcaagcggggcctgcgcctggacgtgctggtcagcgatgaggacttcgcggcctcgtgcggggtggcctcgtcctcagcccgcctggtcttcttctcgcaccgtaagtcctacatagactggatgagcctgcgcctgcgccccggcgcccgggtcgtgctggctggcgagccctccgtcttcaacggccagctgcagttcacccacccggacgtcctcctgctgcctgaggcgggcgggggcgaggggggcgccgaccctctgccgggttccattcgacctgacgcggactcccaggaacaggccctggccaaggtctcgcggcccagaccggtctaccacgccaactcccgcatctcctcagaccacatccatgacgcgattctgggtttcatccgcctcctggcccgggcccacggcggcgggacggctctgggggagcaggcccaaggcgcgaccctcggcacagcccagagcgcgagccaggggcagcccttcgaaggcgagatggaaccggcgatcgacgctgaggctttcggccgggctgtgcccgatatcctgcctgaatcggcgcgcgtcaacgggcactacctccaccgggcccaggccttcctggggatgcatgaccccggcgctgtggaggacttccgcgaggccttgcggaccctgcgcttcgaggaggccttcgtctcccagacggccctcctgcgcagccgcgaggactcccggagggtccgtgcctacccctgcccccagccgggccaggattccttggtcacccgctttgtcgactcgctgccctttcgtctgacccagggccaggaagaggtcatagggcgcatcgggggcgacatggcccgtgactacccgatgcagcgcctcttgcaaggcgaggtgggctcaggcaagaccgtggtcgccctggccgccatgcttcaggccgtggacgccggtttccaagccgtcttggtggcgcctactcaggtcctggccgaacaacacttcgaatcaatcggccggatgctccaggccctggccgcctccggccctgccgccagcgccggcaccgagcccagcggtggcgcggacgcaagcgagggccagtccaagcctgagcacgtaaacgaggcgggccaggtgccgctggtcctgctgaccggcggcatgcgcctggccgagcgtcgccgggccttggcgatccccgcttccggacggccctgcatcgtcgtcgccacgcacgctgctttctccaagaccttccaggccccccaccttgccctcgccgtcatcgacgaacagcaccgcttcggcgtcgagcagcgcgaggccctgcgccgcaagtccgaacgttccccccacctgctggtcatgaccgccacgccgatcccgcgcaccgccgcgatgacgtggttcggcgacctggacatctcttcgctcaccgagctgcccggcggccgcaaacccatcaggaccttcgtggttccggaggcggatggccccactatggcggccatgttcctgcacatccgcgagcgggtccaggctggggaacgggcctacatcgtctgcccccgcatcgacgaggacgaggagggcgctcaaaccgggtctggcgccaagcgcaagggctccgcccgccgttcggctgagggcgacctgccggagatcgacccgtacgcccaggcggatgctgagggcgccgaacctaagcctcgcctgcattcggtggaggagatgagccatcgcctggccgcgctgccccagttccagggcatcagcatggccaccctgaccggtcgcgacgatgatgagaccaagaaccaggtgatggcggacttctcatccggcaagacccaggtcctggtttccaccaccgtcatcgaggtgggcgtggatgtgccccaggcttcgcagatcgtcatcttcgacgccgaccgattcggcctgtcccagctccaccaattgcgcggccgggtggggcgcggcggcaccgacagctgggccttcctggtctcgcgcgccgaatccgattccctggccgcccagcgcctggaggtcatccgtgcatcaaccgacggggccgagatagcccaggccgacatcgagatgcgcggcgcgggcgatgtgctgggcgacgcccagtcgggcggccgttcatcgctgaagctcttgcgcgtggtcaaggacgcgaagatgatcgcccaagcccgggaacaagccgaggggctcctgaagcaggacccggagcttaagggccatgtggagctggcgggcgcggccctggacttcacccggggtaatgagaccttcctgacctccacctgagcccgccgcgcccctgcagcgggcggtccaggaatcatccatcagccagacagagggagggcggcggccatgcgcgtcatcgccggtaggttcaagggggcggcgataccgtcagcgctcaaaggcacccggcccacgaccgatcggaccaaagaggcgatgttctcccggttggacgcttggggggctctgagcggcgcccgggtgctcgacctctacgctggcaccggagcgctcggcttcgaggctctctcccgtgggggtcgcggtctggtcgccgttgaggcctcgcgtcgggccgcaggcttgatttcccgcaccctggccgcgcttaaggcctcaccggcctggggggaggatgacagcgcccaggtgctgagcgtcaaggtcgagcgcttcctggaagcggaggtggaacgttcccgtgaaagccacgcggagcggtcattcgatctgattttcatcgacccgccctacgcgctgccgtcggcggactgcgatcgcatcctggattccttagcggcccgcggcctggccttgtctggatgcctggtcgtcctggagcgttccgcccgttccgagccgccgcagctgcccgaaggctggtccctggatgacgagcggacctacggcgagacccgcgtctactacatctccagaatctagcctgcgagctcagcggcaggctagaaccggctgtttaggcggcgccggccgagcctggcacgggcgccgacctccagcgacgcgacccgttgatcgcgcgaggcgcgaacgaacgctccgaccgggccgcctcctgggatggcgggctggccactggctctggtcctcatgcccctagccagcccgaggcctcgcgctccagggtcgtcagtcctcgtgggggcgggggtgatcgccgtccaccctccagcccaggtcctccagcttggctaagtcgtgcttatccagttgggagcaatccaggcgctcaatcaggtccggccggatccgactcgtgcgctcaagtgcttcatcccagcggaaacggtccactttggcgtggtcgccggagatcagcacctgcggcacctccatgccccgccagttggttggtcgcgtgtactggcggtactccaacaagggtttcgcgccggtgtaggactcctcctcgattgaggcgggattgcccatgaacccgggaagcaggcgggcgatggcctccatcatgaccgatacggccacctcgccaccgttgagcacgtaatcgccaatcgagtactcgcgcacgtccaggccctgcccccggtagtagtcggggatgcgggcgtcgtagccttcgtagcggccgcagccgaagatcagatggtccgcctggctgagctcggcggcatcggcctgtttgaaaagcggggctgaagggttggggaagatgagcacaggccgtccgccccgcccgtcgcgggcttgctggacaggggcgtcctctgacctttccgtgggagtggcttgcgcgtctcccgtttcctccgcgccggccgcatccaggcccagcaaatcatccaggcactcggcccagacctgcggcttcatcaccatcccggccccgccccccacgggcgtatcgtccaccgaatgatgcacgtcgtgggtccagtcgcgcaggttgtgagccttgaccgtcaccagccccttgtcctgggctttgcccagcaggctcagccccgctacctcaaagtattcaggaaacactgaaacaatatcgatcttcatgcccctcactctaaccgtcgccccgccccgccttccccgacgtcgtccccgctctcgctggctggtgagagacgttggcgcatatgcgtaaggcgtcgcgtgcctgccgtccttgggccggataaggccgtccgagggttggggcgggtacaggtccatgcgtcgggttagggaaagattgggcgaaagggggtgtctggggcggggttggtgagatgattgagggtgtggttcccaaccaggcttcatcaatgttgcatgaggccaggcgagttcgggcgcagtcatgatggcgccctgtcggtttcgcaggctgtcgagggcctgcaggcgagaacgctcacggaaaaggggtagacatgaaagtggccatcttctccacctgcgtggtagacctgatgtttcccaatgtaggcaaggacatggtcgaggtcctggagcgcttcggctgcgagacctgcatgcccatgcagcagatttgctgcggccagccgacgttcaacagcggatacatcaaggaaaccaagcacgtgatgcacaacgaggtcgacgccctgcttggcgtggacgcggactatatcgtgggcccggccggctcctgcgtcaacatgctcaaggagcttcccttccacctgaagggtgagccagcgtaccaggctaaggcccaggctgtggcggacaagacatacgaattctcccagttcctctaccgggtcctgggcgtcgagaacgccggcgccgaactggacgccgtggccacgtaccaccgttcctgccacatgacccgcctgctgggggagcgcaccagccccttcgtgctgctggaccatgtcaagggtttgaagatgattccactgccgcatatcgagaactgctgcgggttcgggggcatgttctccatgaaggagcctgagatttcccggcagatggtggatgagaaagtcaacgatgtgctctccactaacgcctcggtcctgatttcctgcgatccgggctgcctgatgaacatcggcggacgttttaaccgccggggcgagaaaatcaccatcatgcacctggcggaagtgctcaaccacaacgtggacatgagccgggtgacctatgtggatgccaaggagaacgaaggggtgccggcatgaagaccgcaacgatgattcgtaataacgaccatgatttcctgacccgcgtcgccgattccgagaagaacaccttcgcccagaaggccgtggccaaggcccaggacgcccagtgggtcaagcgcgagggcgcccgccaggagctgggcaactgggaggactggcgggacctgggcgagcagatccgacagcattcggtgcgctatctgccggactacctggaggagttctccgacaacgtggagaagaacggcggtcacgtcttcttcgcccagaccgacgtggaggcgcgcgacttcatcgtcaatctggccaaggaaaagcaggtcaagaacgtcgtcaagtccaagtcgatggtcacctccgagatcggcatcgacaaggccctgctcaagattgacggcatgaacctgctggagaccgacctggccgagttcatcctccagcaggacgactgggacgaacccacccacctggtgttccccgccctgcacaagaaccgcgaccaggtgcgcgaggtattcatgaagaagctgggctatgagggcgacaacgacccccagcacttggcccgcttcgcccgaaaggtcatgcgtgagcgcttcctgaagaacgagatgtcgatcaccggctgcaatttcgcggtggctgacaacggcatgatcaacctggacaccaacgagggcaatgccgatttgtgcatggccatccccaagatccaggtggtctgcatgggcatggagcggatcgtgccgagtatgcgcgaggccgagaccatggataacatgctggcccgctcggcggtcggccagaagatcaccacctactgcacgttcacctcgcgacaggtggacggggaggccgacgggcctgaggagttctacgtcgtcatcatcgacaacggccgctccaacgccctgggcaccgacttcgagcccatcctgcagtgcatccgttgcgcctcctgcctgaacgtctgcccgatataccgccacatcggcggcgaaggctacggctccatctaccccggaccggtcggctccgtgctctcgcccgtcttgcagggcaattacgacgacttctccgaactgccctacgcctgctccctgtgctcggcctgcacggccacgtgcccggtcaagattccgctgcataagctgctgatcaagcaccgagagattgagatggacgacctgcaccagagcaagctgattgatgacgcggtcatgcgggtggtgggcatcggcaccggccactcctcgctcttccgcatggccttgggcttggaccacaccatgctcacccccctgcagaaatccaagccggaaacagccgagaacctctactccaacggtaagcacctggaatggatgccgttcgtcttcggtggttggaccaaggtgcgcgacctgcctgatccgcctgcccactccaagaacttccgttcctggttccgcgagcataaacgggagcaggccatgcagggaggcggacaacccgctgagccccaagcgcctaagaatccgaacgccttccgtcccagcggcgaacccgtactgaaggccgatgggtactaccaaaatggccatcgaatcaccgaggagagggcgcacgccgaagggcaggccgcagcgcccggacgggtcgcgtcacgggcagcttcgctctcccaggaggaagtaccggctggcagccacatcgacggtgatgacatcgccaaggcagccgcccgtcaggaaggagtgcaagagcatgactgaccgcgagacctttctgaattacctggccgaaaaggcccggcgcccccgccaccagctggccgacaaccccctggtgccggtcaacgacctgccggagaccacactatccggcaagagccaggacgagctgatggagatcgccagggccaacagcaaggccgttaatgtgaacttccagaccaccagcaaggccggtctgccacgcgctttggacgacttcatcagggctaaaatctccgaccgcccggacgacgagtatcaggcgaacggccacaaccacctgttgctgcccacatccgacctgtacgcggacttcggtctggaaggttggagggatggcctgcacgacccggagcccacgttctggaagccgggcgcggggcgggacgcgaacattgacacggctgagcacgccggggcggcgatcgccttcgccgattacatgctggccgagtcctgctcgatcactacggccaccacgccggggcaggggcgggccttccacttcctgccagtgcactacctggccatcgtgcgcaagtcctgcatcctgccgcgctcgcgccaggccatggaccgctacgacaaggccatgaagtccggcgagctcaaaacctccaacatcaacatcatcaccggcccgtccaacaccggtgacatcgagatggtgctggtcgtgggcgtccacggtcccttggacatgacctacctggtcgtcgaggacatgtagggcagagcctgggcgttgataaggcgaccccctgccggaggatcaataatcctggcagggggtcgcggtgcgtctgctgggaggggaggggtacgtggcccctgcctccgcctaatccaggccgggtaagaggcccttgggcgggtcgatgccaatgtatcccgcgtccgggtccacttcgggcactagctgctctacaaacggcactaagccggtcacgggtccggcctcttcgtccgtcccgttctcgccgtggtcgcccgccttgccggtgggggcgagctctatttccaggagctgctgggcggtggcgtcaatcacgtccttgacggtgcccaccagtttgtcagccggcaatcccagggcgttgccgggggccatgcgcacttcaaggccaatgaggtcctccaagtaccaggcatcgtcttgttcttcagtttccgggtcgggctccacgtacagctcggtgccgctcagggcttcggaggcgttccggtccgccacgccctcaaagagcacaatccagcggcttttgaatcgacgggaggatacgacggtgaacgcccggctccggtcggcggtggtgagcacggaaccgggggagaagcggcgttcgggctcatcggtgtacgcgaacacgttcacctcgcccttgagcccttgagcgcgcccaatacggcagaccctcaacagtcttgactgctgagggtctgcaaccgagcgattggcgtccgcgctcacctgcgtacgtccatgatgtcgacgcggatcttatggtcgctgatggcctgggccacggtgcgaacggcgttggccgtccgcccgttgcgcccgatcacacgcccgatgtcctccgggttcacccgcacccgcagcagttcgccacgggcgttctcatgggagcgcacggagacgtcgtcggggaaatcgacaatgttcttaatcaggtgttcgactgcttgcgcgagcatggcaatcactcctccaaacgcttcaggtcccctggggccgctcactcggcggtggggttctcctcttcaccggactgggcttcggcggtctcagcctcgctgtcctgggccgccttggcttcggcttcggccttggccttcgcctcggcctcggacttcttggccttgagcttctgggcctcggcctctgcctgctcgatgcgggcttgggcgtccttctcggcctggggcaccttcagcgtgccctcctggccgggcagacccttgtacttctgccagtcgccggtgatcttgagcaggttggaaaccggctcgctgggctgggcgcccacaccgagccagtactgcgcgcgctcggagtcgatcttaatcgtagaaggctgggtgttggggttgtaggtgccgatctcctcgatcaccttgccgtcgcgcttcttacgcgaatcgacgacgaccacgcggtaaaaggcgtagaacttcttgcccattctcttcaggcgaatcttggttgccaaagcggctctccttgtagctaggtttgcggtatccgcactccatgtggggcatggaatccaggcgccacgtgtcctcgcgcgcgacggtatgagagggcccgtccacacgaataacagcaacagtataccgctcagaccggataaatcgtgcgtgaacgatgcgcctgagccgcgcgacgggccctggctccagcgggaggtccctcaggctgcttgcagggtggccaccagggccatatgatcggtggaggggatgcgcaaggaacgcagtccggtgcaggccaatccttgggtgtgcaggacatggtcgatctctatgagcgggggcagggtagcccaggatgcggggaacgtgggatgaagccccgcgctggcctcgccgccggcgtcaagcaggtggccgtcgctcagcagacggcggaaggaggggtggtggactgatgaattgaggtcgcccatgatgagcgcgtcatccgcgtctcccgcctgccgacgcgcgctggcttgggcggcgggggagggggccgcagggctcaggcccgccagagccaaaatcgaggccccccagttgctgccgccacgctgaggggatttggggtgggctgacgcgaccagtatcgtgcgccccaaagcttctaccgtcagtgtcggcacggcggaagcgggcaaggataccgattgagggcgccggcccttcggctggatccggctgaataccgcattgaaaccgccgttgtcgtcagtggtggcgacccctactgattggtagggcagcaccatgggcagtccagcttcccggaggcggtcgagcagggtctggctgacctcttgcaaagcgagcagatccacatgctggcgctcgaccgcggcctttatggcctgcgcatcggcgtggccatacttgcagttcaagctcatgacggttaaacgctttgggctgaccgtagcggcgtcaggctggctgaaacccggaagggcggatatggcaaggaccccggaagggaggtggagaaggaaggggaggagccagatggtttccaggagcagcagaagcgtggcggctaccgcttgaggccaggcggtgatgaccagggaccaaacgagcagcaccatcaaaggcgcgctcagtagtggtacgagggctatcagctcgggcaggggccggtgccagtcccagccggcgggcaggtagcgcaaggccatccacagggcgcatagggccagcagggcccagagcagggtggacacgcggctgtcaggctcctaggagcccgcccaggccaccgcctaggttcggtggaatctggggcatgccatcgggcacctgagtggtctggggcttcgcgaaagcggaacccgagttgggcgcgccggagcccttgcctccggacaagcgctcgcgcaaggccttctcctccgcctcgcgcttcattgggttgccggagcgggatttacccttcttcttgcttttcttgcccttcttcgaccccttgcccccaaaaccgggcataccgggcatctgacggacgccgttggtcatccgccgcatcatcttggcggcctgatcgaagcgctggaggaggccgttgaccgaggagacggtgacgcctgctccgtaagcgatgcgggcgcggcgggagccgtcgatgatcttcgggtcacgccgctcctggggggtcatcgaattgatgatggcctccgtgcggtcgacctccctctcgtcgaactgctccagctccttgcggtgctgggccatgccggggatcatgcccagaatcgacttcaaggagccgagcttgcgcacctgctgcaattggtccatgaagtcgtccaggccataggagccctcgagcatcctctcggcggccttgcgcgattcctcctcgtcgaactcgcgttgggcctgctcgatcagggtcaggatatcgcccatgtcgaggatgcgggaggccatgcgatcggggtggaagacctcgaagtccttgagcccctcgccgttggaagcgaacagaatcggtttgccggtcactgaggctacggacaaggccgcgccgccacgggcgtcgccgtccagcttggagagcaccacgccggtgaagtccacgccctcatcgaaggccttggcggtttgcaccgcgtcctggccgatcatcgcgtcgatcacgaacaggatttcgtcggggtggaccgcgtcgcggatgtcgcgcgcctgagccatcagctcctggtccacgcccagacggccggccgtatcgataatgaccgtgtcgtagagcttggactgcgcctcttgaatcgagtcgcgcgccaccttcaccgggtcgccggtggcttgaccaggcgaaaccacgtccgagctttcggtctgtacgccgggctggggggcgtacaccggcacaccggcgcgctcgccgaccacttgcagctgggtcaccgcgttcggccgctgcaggtcggccgccaccagcaggggggtgtggccagcgtctttgagccagtatcccagcttgccggccagggtggtcttaccggcgccctgcaagcccgcgagcatgatcacagtgggcggggtcttggcgaagttgagcggccggtccacgccggcgcccagaatctgcgtgagctcgtcgttgacgatcgagaccacctgctgggccggattgagcgcctccgacacttcggcgcccaacgcgcgttcgcgcaccttggctgtgaaggaacgcaccacgtcgagcgacacgtcggcgtccagcagggcgcggcgaatctcgcggatggtgccgtcgatatcggattcactcagcttgcccttggaacgcaagtgggtgaaggcgttcgacagcctgtcggtcaaagaagaaaaagcagccataatcccataattctagcggtcgcccgggaaaagacggcaggaccggccgggctcagccttccagctgccaagtggggccggttggggtgtcctctatggtgatgtgggcctgtgccaggcggtcgcggatggcgtcagcctgggcgaagtccttggcggagcgcgcggtctggcgggcggcgagctcctgggagaccagggcgtccagggcctcgtgggcggtatcggcggcggccccccgtcctggttgggcccaatgggggtcaagagggtcaaggccgaacacgtcgagcatggcgcgtacgtccagcaggtcccgcagcagtccgtcctgggcgtcgcgggcgttcgggtcaccggcaatcccggccatgccggaattagcgcggcggatggtggcgaacagaaccgccagcgcctcgggcaccttgatgtcgtcgttcatggcggccacgaaatcggcgggcaactggtcggccgtgcgctcggccacctcctgccgggagggttgccagcccagggccttaccggcgcgatccacgaacccgttgatgcgctcataagccgcctgcgcctcgttcatggtctgatcgccccactccagcatggagcggtagtgggtggaaaccagcgcgtaccgcaccacccaagcggggtaggcgtccagcacggcgtccgcggccagcccgttgcccagcgatttggacatcttctcgcctttttgcgtcacccaggcggtgtgcatccagcggtgggcgaacccccacccagcggcgtgggattgggccatttcgttctcgtgatgagggaagcgaaggtccagtccgccaccgtggatgtcgaaatccgcgcccaggtaccgccggctcatggccgagcattccaggtgccagcccgggcgtccggtgccgaacggcgtggtccagcgggcggtcggcgggtcggtgggcttggaggccttccaaagggcgaaatcccggggtccgcgcttacctgaggccaggtcggcgtcgtcagccggtttgtactggtccggcccttcggcgtctacgctcggccccatgcggtcggccacggcggcttgctcgtcggcggcttgggtgccggtctcctggtgggtgagcgccccgtactcgggccaggattccacgtcgaagtacacgttgccggatgggcggccttcctcgtcgggcacgatgtaggcgtggccccggtcgatcaaccgttccaccagctcaaccatctgcggcacatgcccggtggcgcgcggttcgtaagtggggggcagggcccccagggtgtcgtaagcggcggtgaactcgcgctcatagatgtaggcgcgttgccaccattgttggccggcggcggccgccttatccaggattttgtcgtcgatgtcggtcacattgcgcacgagcgtcacttggtagcccagcttgagcatccagcggcggatcacgtcgaaggcgagcgtggtgcgcaggtggcccacgtgcggcgagctctgcaccgtggccccgcacacgtagatccccacccggtccggttcgatggattcgaaggcgctcaccgccttggtcgctgtgtcatacagccgcagccccgccgccgctcggctcagagaatcgttgaaatcgcgcgctttcgagctcatatccatagggttgatgctacccgccaagcctgacatcgagccctgcgtcatccgcccggttccgcgcaggcttgcgcggattgtgcgcccggttttccactcggaagcgagggtggggcgcggcggtgtgaggggcgtgcgtgatgcggtgtcggtcggaggcggaatgaggcctgggagggtggatggtcggggagagtcagcgcttggaggcgtagggagaggagcctgtctgacggggcgtgtgtcgctagggtggtgggcgtgtcacaatgggggtatggcgaaacgcactgtgctggtcatccaacatgcaccctgggaacgagccgggcgagtcggagaggccttggaagacgccgggctcgatattgagaccctgagcgtggtggacgtgaataaacccgaactgccgaagccaggcgagctggccgggttggtcctgatgggcgggcctatgcgggcggatgactacgagcaccacccggggctcaaagccgaaaccaagctggtcaaggaagccacgcaagcggaggtgccggtgctgggcgtctgcttggggcaccagatactggcccgggcgctcggtgcgcgcttgcaacccagcgacgggatgcaccaggggatgggaaccgtgaagtgggtggcgaccgacgatgctgtgtccacctgggcgaacaagaccaccccggtgctgcaatggcattcggactcggcaagcctgccggaaggtgccaaactgctggccaaatccgccgacaccaaggtcgaggcgttccgggctggatcggctttgggtctgcaattccacttggaagtgaccggaccgctgttcgagcagtggcttgacatgccgcaaatggtgaaagggcttaagaagaggcagatagccgagctattggaggacttccaggccaaggacgacctggtccaaccgttggcggactcgatcttctccgctttcgccgcgcgctgctccacctgcgcggcgcagcccgtcggggagtaaggcaggcggactggctcagtcctccagatcctcgccgatctcaagccactcctcttccaggggctcgatttgggcttggatggttttgacttgctcgttgagctggcccaggccctcgtaatcggctgggtcgtgagccgccatccgggcctgcaagtcctggacctgggtgttgagcttggagagtttgcgctcgatggcgcgggcgcgtttgcccagctcccgctgggcctggcggcccgatttgccggcctgggaggaagcgttcttagcggtggcgctataagctgaattcgggctgcgggttccgcgcgcgtcgccgccgatctcgggggaggagcctgtcccagattttgcggatttgaccatatccaggtagtcatccacgccgccgggcaggtggatcaccttgccgtccagcagcgcgtattgctggtcagtcacgcgctccagcagaaaacggtcgtgggagacgacgatcaaggtgccaggccaggagtccagcaggtcctccatgacggccagcatgtcggtatccaagtcgttgcctggctcgtccatgatcagcacgttgggctcgtcgagcaggataagcaggagttgcatacggcgcttctggccgccggacaggtcgcctatgcgggtcatcagctgggcggaggagaagcccaaacgctccatcagctgggaaggcgtgacctccttgccctcgacttcgtaggtggccttatagcgggagaggacctcacggatacggtactgggccagctcctccagctcgtccaaacgctgggtgaggaccgcgaacttgaccgtcttgccgattttgacatggccggaagtgggctggacggtgccgtcaatcaggcccaggagggtggatttgcctgcgccgttggcgccgacgatgccgaaacggtcgcccgggccaatcagccaggtcacgtcgtcgatcaccgtgcgaggcggatacgacttggtcacgttcttgaggtccaccacctgcttgcccaggcgggaggtggccatgcgcttgagctccagggaatcgcggatgggcggtacgtcggcgatcaactcgttggcggccttgacgtggaacttctgtttggtggagcgggcacgggcgccgcgagtcagccaggccagctccttgcgggcgaggttcctgcgcttggtctcggccacgtccgcctggcggtcgcgctccacgcgctggagcatgtaggccgaatagccgccctcgaaggggtcgatcgcgccgtcgtgcacctcccacatgcgggtgcagacctcgtccaggaaccagcggtcgtgggtgacgaccaggagcgctcccgagcccttggaccagcggtgcctcaagtgctcggccagccagtggatggtgaggatgtccagatgattagtgggttcgtcaagggccaggatgtcccaatcctggagcaggagccgggccaggtccgcccgccgccgctgcccgccggacagggagcccaccggggcgtccaggtccatgccggccagcaaggtctgcacgatttcgcgggacttggggtcggatgcccactcgtaatcctcgcggtcgcctagggccgcctggcgcaggctgtcctcgtcgcgcagggggtcgcgctggtccaacctgccgaaggtcaggccgccccggcgggtcacgcgccctgaatccggctcctggtcgcctgcaagcaagcgcaggagcgtggacttgccgtcgccgttgcggccgacgatgccaatccgatcaccttcgaagacgccttgggtcacatcggtgaagatgttcttggtggcgaaagagagggagacgttttccaaaccgaggtcataggtaggcatgattcaccaatctagcgcgcggcctggagcgcgccggaccagttcagcggcccgttcgggagccgatctcggtatccggcactttctccgagagggctttggggccccgggtgaccgccaccgtgccggagcgcaccatctccacaatgccgaaaggggccagcagccccagcagggcgtccaacttgccttgggcgccggtagcctcgatcgtcagcgattcagggtggacgtccaccacgcgcacgcggaagagctggacaatctccagcacgtcggaacggttgcgctcattggctttgaccttgatgaggaccagctcgcgctccacggtccggcccgggtccagctccacgatcttgagcacatgcagaagcttgttcagctgcttgatgatctgctccagcggggcgtcctccgcctccgtggtgaccgtgatgcgggagatgtccgcgcgttcggtggaggaggcggtcagcgaggtgatgttgaaggagcgacgggcgaacaggtcggtgatgcgggccagggcgcccggcctgttctccgccagaatcgagagggtgtgctgctgggtgccgttgttcgtagccattgttcaagccttcccttgctgctcgggccgcggtgcctggccgtcggccccgtgggttgagccctgggccgccagcggggtgacacccggccggtagacgatttcgctgttcgaggcgcccgggggcacgaccggccacacctgggcatccttccagacgcgcatgtcgatgaggaccggccggtcgttgacggccaaggcccgctcgatcgcgccggtgacctcctggcggttgctggccctgatgccaaggcagtcgtaggattcggccagcttgacgaagtccggcaccggcagccccgggccgtccgccgggccggctgcgccggaagccaggtcgctcaggatgtggtggtccccgtagaagagggtctgccactggcgaatcaggccgtaggaggcgttgtcgaggattgcgattttgagggggagtccctcctggcgggccacggccagctcgccgctggaggcctggaagccgccgtcgccctcgatcagccagaccggacgggagcctgcgacgcccactgtcgcgccgatcgcggccggtagcccgaagcccatggtccccatgccgcaggaggagatgaaggagccagggagctcgaagtccaggaagaggctggcccacatctgatgctggcctacgtccgtgacccatagggtgtccggcgaggccaggcggcccagctcctgaatggcccactgcggctcgacctggccgtcgggggccgggtcgtaggtcgatgggaaccgcgagcgccaggcgtcgatctgccgccaccagggggccaagtcggttcggcccaggcgctcttggacgcgggggaactcccggttcaggtcggtcagcacttgggcagcatcgcctacgataggcacgtcaacggtccggttcttgccgatttcggccgggtcgatgtcaatgtggatcaccttggcggcaggggcgaaactctccaggtcgccggtcacccggtcgtcgaagcgggcgccgaccgccagcaggaggtcgcactcctgcatggcgccgttcgccgccactgtgccatgcataccgggcatgccgagcacgtgctggtcgctgtcaggcacgatcccgcgggcggatagggtggtcgtgaccggggcgccggtcagcttcgccagctgcgccacctgctcggaggcgtgggcccgggtcgcgcctccgcccacgtagatcaccggccggtacgcgcgggccaggagttcggccgcgtcctggagcatgtgcccgtgggccttggtggtgggtttgtagcccggcagaatcatccgctggggccaggaataagccatgctttgggtttgggcggtgtagggcaagtcgatcaacaccgggccaggccgtccgctgagggccacatagtaggcctcggtcagcacgcgggggatgtcctgggcctgggtgaccaggtaggagtgcttgaccactgggtaggtcatgcccagtatgtccgcctcctggaaggcgtccgtgcccatggcctcggcccccacttggccgctgaccactatcaggggcaccgagtcgcgggccgcctccgcgatgggggtcaccatattcgtggcccctggcccggaggtgaccaggcagacacccggctggccgacggccaacgcatagccttcagcggcctgaccggcggcctgctcggtgcgggtcaggacgaagcggaacttcgtgtctgggccgatcgcgtcgaaagtcggcagaatctggccgccgggcaggccgaagaccaccttgacgcccaagtcctccaaggagcggacgagggcctgggccccggtcatcggctcgccggcgggctccgcatcgcgcgcggtgtctttgtctgacggctccttgggaaccgagttgaatgcttgcagaggtgtcggcagtgccatcaagctcctatcccctcgtttttatacagtctaaacgccagaccgacaggatggggaagcggttcctcatagtgggaaggccgtgagggggggggggggggaggcttccggctggggttgagccggcagcgcccttggctgactacggggcggggatgggtcaggagcggtcggagctgttctcctcctacgcctcctgcttggactgttcttcctgggcgagctcccgctcctcggcttgctcctgcttgagcgctttcagggcgctgggtccatccaaggccttccacgcctgttcggcggcggccagctgggccttgcgcttgctggaggcccgtccgtggccgatgaccgagtgggtgccctctaaaaccaggtccgctgtgaagacctgggcgtagtccggtccggagaccgccatccggtactcgggttggcctaatcccgactggcgggctttcacgctgattgaggtcttccagtccaaggccgggccttcggtggccacttccgccagcgtgtcgtccaccagcgtgtggacggtcttgcgggcgccctcgatgccgtgttcgatgaaaaccgcgccgatcagcgcctcgactgtgtcgcacaggatcgagttcttgtccgatccgccggactccgcttcgccccggcccagcaggatgtactggcccaagtggagcttgctgcgggctatggcggacagggagtcctccgagacggccttggccctcatcttggccagctggccctcgttcatgcttggatggtccttgtacagggtttcggtggagaccagctccagcaccgcgtcgcccaggaactccaagcgctcgttattgggcatcccctcgtgctcgtgggcgaaggaacgatgggtgagcgcatggatcagcaggtccggcttgagggattgccccagggccttgaagagctccctggcgggcagctcctggctagcggtcccgtcttgcgcctcctggctgcccgccgcctcggtccgcatggcggcttgcgtcgacctgccgtgcgtttcgctcccctgcgcttcgtcgtgacttgatgaggtcatgtcccgctcctaaccagcctgccgaggccttcctcaggccagcgcgcgggcgttgtatcaatccaagtacgttaatccgaatatcaaagggccccgccacccgtcgatggcagggccccgtatgatgccgccagcggccggatcaccggcctgtgacgggttcgcgctcacttggcggcgaacttggaacgcatagcatccttgtagacgcggccgcggaaggtgccgcaggaggggcaagccatgtgcggcagggtcggggccccgcagttggggcaggcgaccgtgctcgcggcctgggtcttccagttggcgcggcgcgaatgcgtgttagcgcgcgaagtcttgtactttggcagtgccattgtcttcctctgttccgatcgaaactacattgagcttaagcctagagcagtctagcgcataccctacccaaaagccaagcggccggacaagcgctggaggcccgccggggttattcggccgctgggccagcctgccggccttgagcctcgcgctccagccgggccttgaacgaggtcagggcggcgaaacgatcgtcgctcacctcgtggtggtggtcagggtgctcgttcaggttcacgccgcactgggggcacaagccccggcaatccggcttgcacagggccttgaagggcagggcctccaccaggttgtcgcgcaggagggcttcgatgtccgtcaccgtgcccgaatccgccaaggggtaggtgttgccgtcgtcggcttcctcctcgccggccacgatctccacttcgccctggagctgacgctgctcgcgcgggtcctcgaaggggaagaaggccacgacgtccaactcgcgtgggccggagagcggcttgaggcagcgggtgcactcggcgtgcacgggggcgctgaggcgggcgttcagaatcagtccgtccacgatcgaatccatgctgccggacaagtggaccggttcgccctcggtcacgcctacgatggcatcgccgatgccactgggggcggggaaatcagcgtcaatcggcttgctctgcccggctcgctgggccacttgcgccactggtatagcccagggtgagtctgctgctctcgtcatatcagtgttcgtctcctttagccttcatgtgccgcgcccgggcggccacctggtgctgccggggcctgcttggtccgccaaggcctgcttattggtcggaatgctgatcggggttctggtcggagtaagacccctccagcttggaggcggcctcgcgttcgcgttcgcgcagcacttcgacgcctgcctgcacgtcttgctggtaacgctccagttgggaggccaacgcttccatcaccttggacgaatactggttggccccctggacgagcttatcgctctgggcttgagccttatcgaggatgacctgggccttgcgctgggcgatcgcgaccacgttctcctggccggccaggaattcggcctgcttcccggcctctttgactacgtccgccgcccggctttgcgcctccgagatgatggcgttggcttgggtctgggccccgtccaagcggcgctcggactcgcgcatcaaggccgaggcgcgttccaactgcactgggagcatcttcttcaggtccgccagggcccccaggaactcctcgcggtccaccttggccacggagggggtgaagaccgaggacttggcctcctcaaggaggttctccatcttgtcgatgatgtcgtagacggtcgtgaactcggccctggatgtgggggaggcggcggatgcggtctcgttctcacgcaggtcaggcatggcctgcaactcacgggaagcaagcgatccctccgctgctgcgggtttgcgcttggatgccttgcctgcgtcggccgcggatgccgatgacgcggcgaaggccgctgaaggcgtggacgctgcggtgtggatgtcggtgttggtggcgtcgtccgagtcagaggcgtcggctcctgagtccggctcgacctgtggggaggcggcgggcatggcggccgaggacgtggaggacgcgaaagtcacggaagccgcgggcagggagggactggtaggtgttgggcgctgtcggttccgccgggccttggcggccgcgacggtcccagtgccggtcatgaagccgggcagggaccctgtcatggctgggccgccggaattggccgccactggggtcgggctccctttctcggaagccttggctgcggggagcgaagcgcctggctcctgggccttgaccctgctgggcactgcggtcgaggagttggtgctgtcgtcctcagcgatcagcctgcgcgcgcgtccgctggcctggatgggcatatcggcaacggaatcggccggcttgaagcgggcgttcgggtccgcgtcggctttggtggcctggccttccggctcgccgctacgcttgttgcctgtgccttccgtcatgtcagctctttcccttgttcatcgccatttgcagtttgccgatcacgttgtccggcaccatgccctctatgtcgcccccgtgccgggccacgtccttcacaatcgtgctggatatgtgttcgcgcaaggggtcggccggcaggaagagggtttccacgtcggagagcttgcggttcactagcgccatgcccagctcagcctcgtaatcgccgttctgccgcagccccttgacgatcaccgtggcccccacctgcttgcagtagtcgatgatcaatccgtccgtggatgccaccttgatgttggagtagccgtccgccgccagcgcctcctggaccatgcccacgcgctccgcctccgagaagaggggcgttttggccatgttgaccgccaccaccacatggacctcctcgaagaaggaggcgcagcgctcgatcacgtcaagatgtccagaggtcacggggtcgtaggacccagggcacacagctatagtcatgccttcaagcctaccgcgcgtcccggaaaccaaccactcgcgtgtagctgcccgctggcccagcgctctgcggcgatgaggtggtgagggttgactgggtcggtatgatggggggtatggagacgatgacttgggattggacggacgaggacgcgccggcgggcagccctgaggagggccgcgggacggccctgctggagcggcctgagacgcgcgaagagacgcagcggagcgacaccggcgacgccgaccgttactcccactatgtgtcggcggataagatcgctgaatccaagttgaccgggcggccggtggtggccctgtgcggcaaggtatgggtgcctaagcacgacccctcgcgctacccggtgtgcccggactgcaagcgcatctacgagcagatgaagcagggcgggttctaagcgggcaaagcccgtggcagggcgacgaacccccgtggtggccaggagcggccgctgcgggggttcgtcgctagtggggcgaagcgcttttcgcgggcgcctagcccaggctggcccggtcgatggctgccagctcctctgcggtgaaggaggtgttggacagggcgccgatgttgtcgaggatttgctgggacttggaggcgccgatcagcaccgaagtgacgctgtcgtcgcgcaggatccaggccagggccatttcggccagggtttgcccgcgttcgccggccaggcggttcaactcgcgtatctgcgccaaccggccctcggtcagggcatcggacttcaggaaccgtccgtccactttgatgcgggagtcggccgggatgccttgcaggtagcggtcggtcaggagcccttgggccaaggggctgaaggtgatgagccccttgcccagtcggctggccgcgtctttgagcccgttcctctcgacggtgcggtcgaagatcgaatagcggttctggcagatgatgaaggggcagtgcaattcgttcaggatggtcgtggcgcgttccaaggcggggccgtcgtagttggacagtcccacgtacagggccttgccggagctcaccgcctgggccagggcgcccatggtctcctccagcggggtgttcgggtcggggcggtgatggtagaagatgtcgacatagtccaagcccaggcgctccagactctggtccaggctggagagcaggtatttgcggctgccccagtcgccgtagggccccggccacatcaggtagccggccttggtggagatgacgagttcatcgcgatggccggcgaagtcgtgggacaggatctcaccggcgtggcgctcggcggcacccggttgcggaccgtagttgttggccaggtcaaagtgggtgatgccgtggtcgaaggccgtgaagagcatggatttcatatgctccacaggcgtcaaatcgccgaaattgtgccacaggcccagggagacggcgggcagtctgaggccgctggtcccgcaacgcctataggacatcgactcgtagcgatccggcgcgggtatgtattgcttggcgcactcgtccatcatgtttcctttccagcgggggacggtccctcgcttatgagcgttcgatacgtgttcgttacaggtgcggctgacggtcggggcttgtgccgcgcgtgcgcggccagcggcccggagcgctgagcctgggatctaggagcccctgcttggcggcgcctgccctccgccggttgcgctatcccaaactttgggtgagcgtgggaatgaccggctcgtctttcatcaggctcatggccgcgatcggcagctcagccaggctggcggcccgccggtccctggcccgcagcagggcctcgcgccccacaaagtccgggttcgtctcgccgtcctccatatacgtgtccagcaggttccgccagccctcggggggctggaaagcgtccagggcctcctcacccccggccacgacctgctcgctgacggcccggccgtcctccaaggcgcggaaggccagcttgcgaccgggcatcgaggccttgccgacggacctcttggccacggggaccatcgaaccgtccgccccctcacgctccaccaacttgtagaccatcgcacaggtgggcgcgcccgagccggtgaccagctgcgtgcccacgccgtaggagtcgaccggcgcggtcttcagggccgcgattgcgtactcatccaagtcgttggtcaccgtgatagtggccttgcgggctcccagggagtccagcagggcgcgcacctgctgggccagggaggccaagtcgcccgaatccagccgcacgccgcccagatcgggaccggccagttcgaccgcggtttggacggcctcgcgcaccgagtaggtgtcggtcagcagggtggtgcccttgccgagagcttggatttgcgaggcgaaggcgtcgcgctcgctgtcgtgcaggagggtgaagcagtgggcggcggtaccgatggccggtaggtcgtagagcttggccgcttgcaggttggaggtgccctggaatccgccgacgatcgctgagcgggccgctgagaccgccgcccactcgttggcccggcgggcgcccatgtccatgcaggggcggccctcggccacggagaccatgcgggaggcggccgaagccacggccgaatcgtagttcaaggtggacagaatcagcgtctccaggagggtgcactgcgcgaatgtgccctcgacttggaggatgggggagtccgggaagaaggtctcgccctctcggtagccacggatggagccggagaaccggtagtcctccaaccagcgcagcgtgggcgggctgacgatatggcggtcagacaggaagcgcaggtcgtcctcgctggggtggaaagcgtcgatggactccatcagccggcccgcccccgcagcgaccccgtagcgccgtcccaggggcaggtgacgggtgtagacctcgaagacgcagcgccggtcggccgtgccgtcctgcaaggccgcgtccagcatcgtgtactcgtacatgtccgtcaacaaagcggtgggcgcaccggcccccgggcacatgctcatgactcgctcgttcctgcgcgccccgcgcgagagctgccggaccggccctgtcgaggcgcgccgcccagggctccggccgttcatgcaccagcttagctttcaggccagatagggcctgccggctccgcccacctgcgccgtcaggtgcgcgtcgcttgccaaggcgtcgctctaagctgggcgttatgagattcctggcctcgttctacaggctcgccctggccgctttcgcgctcgcagctagctaccaaggctggctcaaaggcatgggcagggcttggacgcccctggatttccaagcctgcttggtgctggccttcgtcatgctctgggccggggccgcgagcctgctcaagggtgtcgagccgccggcctggctcaagggcttcgccattctgtactcactgattggagccctggccgcgtgggccatggaaggttccgccggactgggttcgggtccgcgagtctggggggtccctgtgggcttgatgacccgggtcctgataccggttatggccgccctggatttcctcctgttcgacccccacaggcgcttctcctggcattatcccctctcctggatggcctacttgccctgctatcttgccttcgtgctggtgcgggccgcgatttggccgggttccggctcaggcacaggtccgaacgccctcgccaccccttacccctatccgggtttggatttgagggccttgggctgggcgcggctgaccgtcaacgcggccgaatacctcttagtctgcttcgcgctcgccttgtgcctcttcctggtggatcgcatcttgcccaggcgtacgggcttgagcgtgggcggagcctagggctcaggcctgcctgtatgagttagagtaaaacgtgggcgcttcaggaagcaggggcgcgtatgagctccgggcccaagcggcggtcggggaaaggcggtttcagatggcggctatagcggacatgatcgcgcagggcaccgtggtgcggcccgacgggcgggctgcggaccagctgcggcctgtgcggatcacgcgcggatggacccaggcgcccgaggggtcggtcctgatcgagtgcggcggcacgcgggtgctgtgcacggcctctttcactcccagcctgccccgctggcgcaaggagtccggcctgggctgggtgaccgctgagtacgcgatgctgcctagggccacgtctgaacgcaccgcgcgcgagtcggtgcgcggcaaggtgggcggtcgcacccaggagatttcccgcctgatcgggcgctgcctgcgcggggtggtgaacatgaaggcccttggagagaatcagattcagatcgactgcgacgtgcttcaggccgacggcggcacccgcaccgcgtcggtcaccggggcttggatcgctttggccgacgcgctcaagtgggccgaacgccataagcacatcaagaacgccgaacgcgccctgaccgggcaggtgtccgccgtgtcggtcggcgtgatcgatgggcggcccatgctggacctgccctatgtggaggacagccgggccatgaccgacatgaacgtggccatgaccggtgaaggggacttcatcgagattcagggcacggccgagcaccgccccttcaaccgccaggagctggggaccttgctggaccttgccaccaagggcaacaagaccctgcagaccctccagcgccgggccttggaagcggagcccgggcagatggtcggctcgaccggggcggaggcatgagccgtgaccgcgccaagcggacgggtggtcgtcgccacccataacgagggtaagctcatcgagatgcgcgccatcctccaagccagcctgggggagctggggggtgggcggtccgtgcttccggacctgaagctggtctcagccggacgactcgggctgccggaccccgccgagaccggcgtgacatttgagcagaacgcgctgattaaggccaaggatgtggcccgccgcaccggcctgcccgccctggctgacgactcaggcctggtggtggatgtgatgggcgcggctcccggcatcctttcggcccgctggtccggcgtccacggcgatgataaggcgaacgtccgcctcctgttggcccagatccacgatctgccggtcagcgagctgggagcccggttcgtcaccgccgctgccctggtcctgccgccaggcgtggggcgtcaagatgcggccggccgccagggccctactgagttcattcgcaccggccgcatggaagggcatctgattcacgagccccggggagagcaaggattcggctacgacccgattttcgtgcccgacaatcagcctgagcgcgcgcgtgaagccggcctggagctcacctctgcccagctgacgccggaagagaaaaacgccatctcccacaggggcaaggctctgaaagccatcatgcccatcctgattgagtccctggcctgagagccggctgagagaacaccgcgactgctaggggaggcccctgcatgcccactatgcgcgctcacaatgttcggggcacttatcattcagctgatatggtcaatgtttaccatttcacacaaggtggcgttgaggccttgtattctcagtgaaattttttgattttgctgactttatgaggattttctcaaaaaatatacttgataaaatgaattgtttgtgcttacctgttccccactgtccgatggtggccctgccactgtaaggatggaggcggatgcaggtggaaggcatcgctggaggtgagtccgccgctgcagtgagtaaccaacgagggcaagatggtgcacccgtgattagcctccagatgcggatgacaggtgagcatgagcatatgtaggaagcggttgggtttgacgctgactatggcggcgacgatgggaatggcgatgatcctggtggtcttggctgtgctcgcaccgcactcccatgccacgccaacatctcaaggggatgacctggctgcggtgcctgtggaccctaaaccacggttatacaagatgctggcttacaacaaccgcatcgatacactaaacgatgagcttcgcatggacttcgtgctgcgcgtccagcacggacaggtcgacacgaactgcgtgcccgcgggcacatcagaccttggcgatcggtgcggcctttccttcctctactcatacagttcggtgggcgacagaccagcccagtattacaggtccacctacctgaacacccaaggcaagaccggcgccacccgctgggcaactaatatcgactcctacttcacgatccataacgtgctgagctcgggcaattatgactaccttacgatctcgttggaagccgacatcggctacccggacagtaacgtttcccccgactatgatgctgccgcaaaggaaaaagtgagctacaaacagccgggcggcgccaagctcaaccagtatgtctacgcgatcgcaggcaaggggaccgcgcactgggaattgggtaacgcgccatttatggacgctcgtacgaagctcgacccccgttacgctactaacatcaccgccgacttcccggcttacgtgtacaccccctactgtctggctggcagcattggtggcgcctgcaatgggcccatgtcgttcatcggctgggatgctaatccgctcctgtggagcgggggccaggccaactggggtatggtgaccgaccacggcttctccgggcgcagcgaacccgcaggtgtcgccccggccaagtcctttttcgtctactggtacaatcccgcctacggcatgatttccaacggcatgcccttcccatgctcagtcaacacatccttctattatcagtggattggacttaaggacgggagcgagtgggtgccggtctcggcgctgacccctaaccggcagctggcgaaagggcagaaggcagtgggccccggcgtgccgccccccgggttgaatgaaggcgccgcctacaacgcgcctaagtccggctacaacctgattgcgcccgggcctagcgacggttccgaatccgcccagcgccccgacggctcgatcgacttcgctaaggctaagctggccgacgggctggacggctacttcaaactggtcacttggccagtgacgaccaatgccaacggcagcaccgacggctgcgtcaccgatatcaaccgtgacgcctacaatcccgaggctggcatcagcgccggcatggaccaggcgatgatcgccgaacgtatcgataagggttggaccgtcggcacggccttctaccgctacgagctgcccaagcccagccgcccggtaatcgacgcgcccgccgacggcagctaccaggacggattgaccccgtccatctccggcagcggcagtcccggccagcgggtcaccctcttcgcagaggacgccactcacccgatcgcggccgccgacagcgacagcaaggccagccgtggtttcgagttggggtcggcgattgtcggcccggatgggcgctggacggtccatgacgccaacgggacccccgagcccaacaagccgggcggctcccgccgttaccatgcttggcaaacggagcttcagtccggctacgagctgacctctgacttctcaaacatcctgagcctgaacttcctggccggtgaggacccggcgccgagcgtgaagtcggtgagcgtgccgcactccctaggtggggccctgccggatggagccgcggtgaaggtggtgggggcagtgaacccggtgaatcccgggggcgagcttaccctctacgccaggccgacggaccgaggcgcgagtggtgccggtggaaccggtgccgcgcgtggctctggtgctagtggagacgccaccggggcgggctccaaggctaccgcttcgggtgcttccgctcgtgcagctgctgtacctagggctataccttcttccggggttgggtctgcatccaccgtcgtgccgactgaggccgccgctccagccggcgccctgcctgacgagggtctggtttacaagcgcagcgacctgcccgtagggccaatggactggcaggcccaggtggatccccagctcttcctggacgtccggcctgcagacgggcgtggcctatactacgacttcgtggtcgtgctgaccaacaaggccggcaagcagatttcgtccacgtcctggacgcagctggtggacatggaagccccagaccccggcgtgtccggcgtccgagccggtaacctgaacggccgcgcggtcagcggccgggaccggattggcgaggagggcgtcagcatccgcgtctcctggccagacggtactagcgccacctccacctccggccccgacggagcctggagcctgcccctgcccgcctcggcctcctccggccaggcgagcgcgagcgccgtggacgctgctggcaacgagtcggccccgcaggactttcaactcgatgacgctaccaacgtgggcactttgcccttggcaggaggccatggttggatggtgtatgtcggcctgctgctggccttcatgggcgctatgggcgtccgtggcctgctgcaacggcgggctggcgtccggtaagcgcggttctgcggcgattggcggatgcgcgccctgctcttggctggttcgtgccgtcgccgtcgggctcaggcctagggccgtgctaaattatgtgagcgggctgacgcacaagcgtacgtggcggaatcggtagacgcgcaggatttaggttcctgtgacttcggtcgtaggggttcaagtcccctcgtgcgcactggctgaatcgtgtcggctgcggcattggaacggcacgttccttctacgctgctgccgtccaggaaagtgatgattccaggcccggagcgccttgaacggcatcaatggtcagtgcctgcttttttcggaatctcccgcgttgagcgtgttgtccccaactccaaattcttcatcctgtggtaaaagtgtcttcagggggggtgagaagcatgaaagagctatgcatgttggaggagaagcggatatggatttcttcgcttggcaaggctggggggccgtcgaagccatagcgactgtcgtggctatggccagcgtcgtggtagcgctgatgacataccgggatgaccgcaagcgggcccgggacgaaaaaatcaatcaggaaaaagaccgcaggcaaaaggccgcttgggtcacggcttgggccgcgaaacacgacggagccaacggggtcatcatcgagaatgattccgcccatttcatcgcggatgtgcagatagacgtttgcggtcactggagtgtgtggccgcagaaggcccatgacacgaaaagcgcgagaacgctgcctggaaaggcttccacgtggtcggtcatccctccgggattctggcaggtccaacctgacgtgaaatatccttccagccatccggtgccggtaaccctcggtttgggggagggcgaatgggttccgaattatggggacagcgcactgtacgtgagcagattggcctataccgattacaagggcgatcgctgggagcgacgcatagccgagagcggtaactgcttggtgcttgggcagccggtgcaggtgaaggatttgcgggaaagcaaggaataaacgacgaacctgcgatgaagagccacttgacagaatcgaactgtcgaccttctcattacgagtgagacgctctgccaactgagctaaagtggcctgctgcctgggtccggccgcacatgccgccgagctcaagagacaacattgaaaattgtagcgggtgggctcgatttgtccagttagcgcagatcggcgggttgaaccggcgcctgtacgtgtcccttgcgagaatggggcctatgagtacggacgatttctacgcgatcatccccgccgggggagtgggcaccaggctatggccgctgagccggcggtcgaggcccaagttcctgttcgacctgccgggccaggggcggaccatgatccaggctactttcgaccggctttcggccatctgcggcgatgaccatgtggccgtctcgaccggcgcccagcacgtcgacgcggtgcgcacccagctgcccgaactgggggtgaacgcggtcttcgccgaaccggtgccgcgcgactccaccgccgccatcgccctggctaccgccgtcctggccaagcgccacggcgaccatatcgtcgtgggctccttcgccgccgaccatgtgatccgggacgatggggccttcgctatgtcggtgcgccaggcggtggccgccgcccgggccggatacgtggccaccatcggtattgcggcctcccgtccttccacagctttcggttacatccatcaggggcgctccctggccgaccgggtgcccgacgcgccggacgcccgcctggtcagcgagttcgtggagaaacccgacgccgccaccgcccaggcctacctggcgacgggggaataccgctggaatgcgggcatgttcgtgatgagggccgatgtggtactggattgcctgcgccgctacaagcccgagcttcaccgctccgtactggccatcgcccaggcttgggatgtcagccctgaggcgcgcgagcgggccatgcgcgagcactgggcgggcatcgagaagatcgcattcgattacgctgtggccgagcccctgtccgtggctggtggcgtggcggtagtgcctggcggtttcggctgggacgatatcggcgacttcaattcagtggccgcactgctgccttcctccaaccggcggaacatcaagattcttggcgacccggaccgggtggtctatctcgattcggccggcgatgtggtcgtccccgacgctgatcgcaccgtggccctgctgggggtggacgacatggtcgtggtggacacgtccgatgccttgcttatcgccccccgcgcccgcagccaagaggtcaaggacatggtcgccaagcttaccgaggaagggcgggagaacatcctgtaaggcctttcgcggaagggttcaaggcgtgaaaaacggctcggtgtgcgcgggttacggtcgcgaggggtctaggtggagcgagaaggtagggcaatgggtaagccggtgcgcccggagcggcgaaaggttgaaccgtggacgcagggccaggccggcggttcggccgcacagtccgcggtcgcaaccggcaagcgggtgcgcaaccttcgcgtagaggccttgcgcctggccgcgattgtgggtatctccgtcttccatgtcttcaccccttggttcttttgggccacccacccctccatcgcccctggcgcggtgggcctcaatccagcgccaggctccatctgccccttggcagccgtcggatggcccctgtggattctgggtttagtggggctgctgggcgcttggggcaaccatattttttatatgatttccgcgttttacctggtcccggacatggcggcgcaggtgggcgcggctggttactggcgcaggcagtggagggcctgtctccatcgttgcgcggtagtgctggccgcagtggtcttctacgccgtgcttgtgctgcttttcagccgtctggcgcgcccggtgcccggggctggctccctggattggattggacaggggcttgagttcatctggctctacatgctcttcatcctcttggcgccgtcctgggcctggctggtgcgccgttatggggggcggcgttgggcccaggcgcttctggcgttcttcgctttcctcgtgtacgcggtgaacttctatgtcgctttcctgtctcagggtgacgtaaaccagcgaggcctgcttgattggcgcaagcagatgagcgccgtcacctacttgctttccttcatgctgtccggtgccctgagctgtcgggtccgccgctcggccgcgcggggcggggccagccgcctggcgtcccctcggttctggggccgcgctttgagcgtcatactgctggctgcgctggcgatcaccggcgccctggtgtggggcaggctccccgaagccctgtatgacttgtcgttcaaatccacttctttgctggcgttcgcgctggcgttcgcggcgctcttctggtgcgcgctgagcggctcagtctccagtccaagcggccgggatcggggccaggtcagggcgcgggcccgtggtttcgcgccgctggcggtgagcgctctggcttccggcatcttgggcttttacatcgtgcagtccttgatgtatgggctctgggaccccttctgcgccaggcttttgtcccgggccatccgcacgggttcagtcgccctcttcctggtcctggggctggtgttcggcctggggttcgtgcttgtggccacgctctttgaccgtctggttcgcaagcctttgctcgccaagttggggttatgaccagcgagggtcaggcggggcgcggcggtgctcgcggcgcttaggcgggctttgcttttttgtgttattttgtccccttttgtgagtagtttggatgatggcatcaaaccggttcgctcggcccatacccgggcggccagcagacggcatttcctgctatgaaaggacctctccatggccatcaatcctcctgtggacgccacccagaccccggcctgggcccagctccagcagcacttcaacgatttgcagagtcagggcatcaacctgcgccgctggttcgacgacgaccccgagcgcaccgccaagctgactttcgaggccggcgacctccacttcgatctgtcgaagaacctgatccagccccagaccttgacgctcctggcccagcttgccaaggaggtgcgcctggacgagcggatcgagcaaatgttcaccggcgtgcacatcaacaacacggaggacagggccgtgctgcacaccgccctgcgccgccccgcgtccgaacaaggggagttgatcgtggatggccaggacgtggtcaaggatgtgcgtgagacccttcagcgcatctacgacttcgccgaccaggtgcgcaccggccagtggcgcggcgtgtcgggcaagcggatcgagaccgtggtcaacatcggcatcggcggctccgacctgggcccggtcatggtgtacgaggccctgaagccctacgcggacgccggcatcaccgcccgctacatctccaacatcgaccccaacgacttggccgagaagacccgcgacctggaccccgagaccaccctgttcgtgatcgtttccaagaccttctccacgctggagaccctgaccaacgcccgcgaggcccgcgcctggctcctggaccagctccaggccaagcgcgcgatcgacggttccgacgcctcccgcgcccaggccgtcaagcagcacttcgtcgccgtctccaccgccctggacaaggtggaggccttcggcatcgacccggccaacgcgttcggcttctggaactgggtgggcggccgctactcggtcgattccgccgtgggcacctcgctggccatcgtcttcggccccacgcgcttcgaggagttcctcaagggcttccacgcgatcgacacctactaccgcaccacgccgttcgagcgcaatgtggtggcgctgatggggctcatgaacgtgtggtacgtcaacttcttcggggctcactcccacgccgtgctgccctacgaccagtacctgcaccgcttcccggcctacctgcagcagctgacgatggagtccaacggcaagtccgtgcgctgggacggcactcccgtcaccacccagaccggcgagattttctggggcgagcccggcaccaacggacagcacgccttctaccagttgatccatcaagggacccgtctgattccggccgatttcatcgctttcgccaatacgcccaacccggccaaggacggcgaccaggatgtgcacgagctcttcctggccaactacttcgctcagaccaaggccctggccttcggcaagacggctgacgaggtacgctccgagggcacgcccgaggccatcgtcccggctcgtgtgttcactggcaaccgcccgacgacctccatcttcggcgaggctctcaccccatactccttgggtgagctgatcgccctgtacgagcacatcacgctgaccgagggctccgtctggggcgtggactccttcgaccagtggggcgtggagctgggcaagaagctggcccaggagatcaccccggccatctccaaggacgatgcggccctggcggcccaggaccagtccaccaagtccctgatcgccttctaccgggcccaccgtcactaaggcctcgcggtggcctgaaactcgcggggcggcgccgtcggtccgccgtcgcgagtttcaggggccaccgccaaggaaaggcgcgaacccaccggttggggtcctggcgcgggatcgcgtgcgcggggtccggtcggtggggtaaggttaagagatgttgtgccgggagacgggccgccgcataggtcccctccctcaaggtccagccggttcgtccggcggatcggcgctcctcgtgggctgacccacggggttaagcagaggcaggacggtggtcgaaccgggccgtgcccaaggacagtgcgctgatatgcggcggcgacggaggcagattatgaacgcgattgatcaattcgacgccaagcacatgaaggatgcggacgcgattccgtccttccgccccggtgacaccatcgaggtgaacgtgaacatccgcgagggtgatcacactcgtattcagactttcaccggcgtcgtcatcgccttgtcgggcaagggcgtgcgcgagaccgtcctggtgcgcaaggtcagcttcggagtaggtgtggagcgtcgcttccccctgcactccccgcagatcgattcgattaaggtcacccgccgtggccgcgtccgacgcgccaagctctactacctgcgcaacctgcgtggtaaggcggcccgcatccccgagcgtcgtgacgccaaggaagatcagcgctgagttcgctccaggccctgagggtctggtcgggtggcttttgaacgaggtcgcctatcatgtggagggtccgaaagtctgacggctttcggaccctttctgcgctaagctgccaagagcggcggacctcgctcggggtccgggcccttgtgcccgctcgcgtcgtgtcggtaggcggggtcgttggaacccaggggaaggaacttacatggccaggaagggcggtggcttgagggaccagtcgcgtcccaaccggctttccgcgccctatgccaagcccaagtccggcgacgaggttcgtgaggccttcgaactccacccccgccacgctacacggatggtcctgcctgaatccatccgctatgagttggtcgacactgtgcgcaacttcatgctggccgtcctgattccgatcctgctggtcctgacggtgcgcgtctttctggttgggcagtacatgattccctccggttcgatggagaacacgctggaggtcgaagaccgcgtgctcacgagccaaaacctgaccctcaacctggctaagctccagcgtggcgacgtgatcgtcttccatgacccggccgattggctcagcggcgagagcgcctcgaacgcgggcgatgatttcctgatcaagcggctgatcggcctgccgggggacagggtctcctgcgcgggcaggggagagccggtcaaggtcaacggcgtggccattgatgaatcctcttacgtaaaggcgggcgtgcagccgagctcattcgctttcgccgtgacggtgccggccgggcacctgttcgtgctgggcgacaaccgcgccgattcagcggattcgcgctatcacgtcgatgatggcgcccaaggcacggtgccggtggagaacgtggcgggcgtggcgctggccacctgctggcccttgagccgtttcaagcggctggacaaccagcatgggcccttcgcttcggtgcccgatatcaatcagtctgttgcgtcggacgctgccgacggccccgcctcgcaagccggttccgcttccagtgccagcgttcgttcggagggtcaatgacggcgcgtcgggtgaaacccaccctggccctggaacgctccctggcggacctgggcgcccgctgggtggtcgggtttgacgaggtgggacggggagccctggcggggccggtcatggtcggtgccgccgccctgcgcgccgaccgcctgccggatttggcggtgccggaagggctggccgactccaagcggctgagcccagccgcgcgcgagggccttgtcccaggtctggagacctgggcggatgcctgggctgtgggttcggccagcaatcaggagattgaccagtgggggatcatgcacgctctgggcctggccgctttgcgggccctggccagcgtggaggagggcctgggcctggcggggccctgcgggtgccggtccggcgcttcggcttcgcggaccttggccgcgatcctggacggcccttacgactacatatccaaggccctgggcaccctggacgccccggttccccagcttccggcggaagtgagcgtgcaagtcaaggccgatgcctcctgcgccagcgtggcttgcgcctcggtcctggccaaggtgacccgcgaccggctgatggtggatttagcgcggacccaccccgagttcgccccctacgattgggccaataacaagggttacggctcgcccaagcaccaggcggcgatcgccagccttggccccaccgacctccatcgggtcagctggcacctggtttgactcctgcattgagggccagtgggggagtaagctcgtaagggccttgataggcgggagcgaaggaggtggccatgccggcgaccaggcgagggagcaatcgtccatccatctttcaggtggcgcatctggcaggggtgtcccaccagaccgtctcgcgtgtcatcaaccattcgcccgacgtctccgcgcccacccgcgctaaggtccaggacgcgatcaatcgcctgggctaccggcccagcaactcagcccgcgccctggcttcggcccgctcccgcacgatcggcctgatcgccggcggggtggaccacttcggcccggtctcctcgatcacttcgatcgaatcgatcgcccggcaacacggcctgttcatgtcggtcatgatggtggacgaggccagctgcacccaggccgacttcgagtccatgtgcgagagcttcctccagcagaacgtggacgcgttcattttcctgaccccgaccgatgccatgttcgaggcggcttgcaaggcgcaggtcagccagcccagggtgatcgtcacctcgacccacggggccatgcgcgccgacgagggcctaagcctggtgcgcgactcccggcctatcgccatgaccggcatcgaccagtggggggccgtgcaggaagtggcccggctccttcacgcccgaggccacaggaccgccttgtatatggctggccctacggagtggcgggatgcggccacccgcttggattcctggagggcggcggccaagcactacaggattcgcaccgtggtggtgcgctccggcagttggcgggcccgcgagtcctacgccctgatgaaccacctgatcgacgagcgggggatgaacgggagctccctgccgtcggtcgtggtcaccgccgacgacaaccaggccgtgggggcggcccgggccctgcacgagcacggcttgcgcatcccgcaggacatatccctggtgggattcgacgacataccgactgtggataacatgtaccccccgctgaccacggtccgcccccgcttcgctgaccttggggtcgccaccatgcgccaggccctggcattgacgaaccagggcgccccggttgagcttccggtcacgcgccacggggtggggctgatccaggccgacctggtcctgcgctcctctctgggccacgccgtcagccggctctagcccataccgtcccccgcctccgcgtttgctcaagcgggattgagcgactataatctgaccatagaatgtgagcgctcacaatccatgctcagacggctgaatacccggccgctgacgggggtcgagcgcgcaggcgttgattggtcacaagggagttgcgccatgacgaatccgaatgagagcaagcccacgccccagggcgcggcccaagccataagggaaggcaggacccgcctgggcatcgagctgggctccacccgcatcaaggccgtcctgatcgacgaggactgccggaccttggcttcgggcgattacggctgggagaaccagctggttgatgggctgtggacctatccgctggaagaggtttggcggggcttgcaggccgcatacgccgccttggccgaggacgtgcgctcccgctacggtctggggctgacgcgtataggcgctatgggcttttccgcgatgatgcacggctacctggccttcgaccgttccggtgagctcctggtgcccttccgcacctggcgcaacaccaacaccggccaggcccacgagcggctctccgagctcttccgcttcaacatccccgagcgctggtcgatcgcccacctctaccaggcgatcctggatgatgagcctcatgtgccccggcttggctttttcacgacccttgccggctacgtgcactggaagctgaccggtcgcaaggtcatcggcatcggcgacgcctcgggcatgttcccgatcgattcgaccacccgccagttcgaccaggccatgctcgacgccttccggggcctgcccgaggtggcggcccagccttgggacatagccgacctgctgcctgagcccctggtcgctggccaggacgctggcagcctgagcgccgagggggccaagctcctcgacccgaccggcgccctccagcccggctcgccgttggccccgcccgagggcgacgcgggcacgggcatggtggccaccaacgcggtcaggccccgcaccggcaacgtctcggccggcacttcgatcttcgctatggtcgtcctggaacgccgcctggtcgccctgcacccggaagtggacccggtcaccacgccggccggcgacccggcgggcatgagccatgctaacaacttcacctccgatctgaacgcctgggtgaaagtcttctccgatttcgcccaagcatccggactgtcgatgagcgaaggcgacttgtacgccacgctcttccggtcggccctggagggggacgcggacgcaggcggattggtcaactactgcttctactcgggtgagttcctggctggcctggagcaaggtcggccggttttcgcccggggccctgagtcccggatgagcctgtccaacttcatgcgcgcccagctcttctccgccttctcgccagtcaaaatcggcatggatgtgatgaccaagcaggagggggtgcaggtggattctctggtaggtcacggcggtgtcttcgctacgcccaaggtggcgcaaaaaatcctggctgccgccttcgacgccccgatcaaggtcatggcgaccgcggccgaaggcggcgcttgggggatggccgtcctggccgattacctgggccacagggatcagagcctggcggattacctggattcgcgggtcttcgccggggtcgcttccaccaccgaagagcctgatccccaggatgtgaagggcttcgaggccttcttcgaccgctggcggcaaggtctgccgatcgaacgggccgcgattggggcgattcccctgcaatcctgagccagccggggcttacctggcgaagaagcgtgtaaacggtgtctggatagggcgccacaagacagcgataggagctgaaatggctacattggcagactattcacccgaggtgcgggctgaggtcaaacaggtgcgcgagcaggtggcgaccctgcacgagcagctgattaagtggaacctggtggtgtggacggccgggaacgtctcccagcgtctgcgcagcgcggacctgatggtcatcaagccttccggggtgcgctatgatttcctgaccccgcagtccatggtggtcaccgacctggagggcaacgtggtggacggcctggaggcccccagctcggacacggcctcacacgcctacatctaccggcacatgccgaacgtgtacggcgtggtgcacacccactccacttacgccaccgcctgggcggccaccggcaaggagatcccctgcgggttgacgatgatgggcgacgagttcggcggtccagtgccggtcggcccctttgagctgatcggctccgagcaaatcggcaagggcgtggtggagaccctggagcgctacccccattcgcccgccgtgctgatgcgcaaccacgggccgttcacgataggcaaggacgcggaggacgcggtcaaggctgctgcgatgaccgaggaggtggcgcacaccatgtgggccgccagccagctgggcaagatcatcgagcttgacccggatgacatcgacaagctcaacgatcgctaccagaacgtctacggccagcactgacgctgcccccgccacctcgcctagcgccttggttcgggcctgagccccgccaggacgcgcagaccggtggaaacctgaaatacccagcagtacaatcagccccctcgccacccggagcggcgggcagggggcgggaaagagagcacacccatggaaaacccctttgaaggcaaggaaatctggttcggcgtcggatcgcaggacctctacggtgaggacaccctgcggcaggtggccgcccagtccgccgaaatcgtggacgcttggaacaagaccggcaggattccagtcaagctggtcctcaaacccacgctgaagtcctctgacggcatcaagcggttcatggtcgaggcctcggcagatcccgactgcatcggcgtggtggcctggatgcacaccttctcgccggcgaagatgtggatacgcggcctggaggcgctgaccaagcccctgcttcagctcaacacccagcatcacttcgagatcccctgggacacgattgacatggacttcatgaacctgaaccagtcggcccacggcgaccgcgagttcggctacatcctgacccgcatgggcgtgccgcgcaagatcgtggtcggtcactacaccgacccgcaggtggccgagcagatcggcacctgggcccgcgcctgcgccggatgggacgccgcccagaacatgcgcgtgatgcgctggggcgacaacatgcgcaacgtggccgtgaccgagggcgacaagaccgaggccgaacgggtcttcggcacccaggtcaacacctgggccgtcaacgagctggtctcctatgtggacaaggtcaaggacgaccaggtgaaggacctgatcgaggactataaggccaagtacgacgtggcccccgagctcctggacaagcgttacgactccctgttcaccgccgccaaggaggaggccggcatggtgaacatgatggaggactacggcgccaccgctgccgtcgacaacttcgaggacctcggcaccctgagccagctgcctggcgtcggcgcccagcggctcccctccgagcacggctacggcttctccgccgagggcgactggaagacctccatgctcgtgcgcatcggctcggtgatgggcgcaggcctggacggcggcgcctcgctgatggaggactactcctacaacttcgtgcagggccaggaggagatcatgggctcgcacatgctggaggtttcgccttcggtgggttcgatggccaagcccaagctggagatccacccgctgggcatcggcggcaaggccgaccctgtgcgcctggtcttctcggtcgctccgcgcagggacgcggtcgtggtctcgatggccgacatgcgcgagcgtttccgcctggtcatgaacgtggtcgacgtagtggagcccggcggctccttgaaggtgctgccgaccgcgcgcgccctgtggaagccgcagcccagcttgaaggtgtccgctgagtgctggctgcgctccggcgccgcccaccacacctgcatgaccacctcggtggggcgcgaggcctgggaggacttcgcccgcatcgctggggtggagctggctgtgatcgaccaggacaccacgccggatcggttcgagaaggacatgatgatggaggaaatctaccatcggttggataaccagcgctgagttcggcctgagtcgggcctgagcagcccagtagccgacaaggggccggtcgtcgattgtggcggccggcccttcgcgtgcctggaggcggtgcgcgcgagggtccgagagcgcttcctagcgcgtttgcgcgagattcgaccacatggctgacaggcccctagtccggcggcgggtggccgactagagtggtccctggaaccgacggagacgaagcgcgcggcgtgcgcgcggacgggcggaggaagcgactatgggccaagtgccgggtatcgcgttgcgggacggtaggacgattccccaggtaggcctgggcgtgttgcgggtggaggacgagcgcaccgccggggtggtggcatccgccctggaagtgggctaccggcatatcgacacggcggcgggctacggcaatgagcgaggcgtgggccaggggctggcccaggcgggtctcgccgattggccggagcgggaggatttgtggctgacgaccaagctcaaagactccgagcagggctatgacaacgcgctgaaggccttcgaccgccaacttggtctgctgggcaccgactacgtggacctgtacatgatccactggcccacgccctttaactggcgggcggaccggacctggcgggccttcgaccgcctgcgccaggagggccgcgcgcgctcgctgggcgtgtgcaattttctgcccgaacatctggatcgccttcataaggagaccggcgagtacccggtcgtcaaccagatcgagcttcaccccagctggcagcagcgggagacggtcgcttactgccgagagcatggcatagcggtggaagcgtactcgcccctggcgcgcggcgccgacctggaggccggaggaggcctgatagccgccatagcccgcgcccacggggtcagtcccgcccaggtgattctgcgctggcatattgagaacgggaccatcatcatccccaagtccgtccgccgcgcacggcaagtggagaacctggatctcttctccttctcgctgagccagggtgagcacgtccaaatcgacgccctggacgggccgacccgagccggccacgatccgttgactttcacttacgcctgattatgggcgcttatagaccaagcggcggctccaggcgcggccgccggagcccgggatcggcccgtttccgctcctccagcctaggcgagcgcctgctgatcgcgctggtggtcgctgtcgtcatcggcgtcaccatcggcttgctcctgcctcgcctgagcccgcaggtctcgcggatgaccgggggctatacggcgagcggcgacgcggcgaacaccctggggaccttgagcgtcgtggaccgacccaaaccccaccaccattacaaccgcgacagctttggcttcaagatgaccgacgaggatggcaacggctgcaacatccgcgaggatgtgctcaccagggatttaaaggacgtgcgcaccaccacgcccggcggctgcaaggtcgccagcgggattttgcacgacccctacaccggcaagacgatcgctttcacccggggggcgcgcaccagcgcccaggtgcagatcgaccatgttgtagccttggaggacgcctggcagtccggggctagcgagtgggaccaggcccggcgctaccagctgggcaacgacccgtacaacctcctggccgtggatggtccttccaaccaggagaagggctcagcctcagccgcctactggctgccgccccaggccagctaccgctgcgactacgtagcccggcagatcggggtcaagtccaagtacgagctgagtgtcacctcccaggagaaggacgccatgatgatggtcctgcactcctgccctgggcagccggtgcccagtaagtgagcgtgggctcgcgcccgataaggggctgatcagtccttaccgatgggcttggcgggagcgttgagcgggggcgtggtcatctgtgtggccgcggcctcctccttctgatcggcttcttcctcgctggtggaagagctgcgggcggaagcggccccaggcacatggacgaaacggatgtggcgcaggaccatgcgggtcatggcccggcccgagcccgcgtcctcgccgcgcacgccgaagtagaccagggccaacatgcagaagcagatgatggcggagatgcgcagggcccactggacgccgaagatattcgaggcgacctgggtggaggcgccaccgccgatggcctggtggtggatggaggtgatcgtctccatcaggatgaccaggaccggcgcgccgaccgctccggctatctggcgggctgtgttggtcacggcggacccggcggacagattcttgggcggcaggttgttcagagaccaggtggtcagcggcatcagcgtgaagcccatgccgatctggcggatgaactggaggatggagaccatgccgatccaggtggtcgctccgatcatgctcatgcccaaggtgcccaggaagaggatggtgcagccggtcagggccacaggccgggcccccattcggtccaggaggcggccgccgaagaactgggcgatggcggtgccgatcgcgccgggcagcatgaccaggcccgacatggtggccgagaagcctcggtcggtctggatgtacaggggcaggatcaccgtcacggagctgaaggcgaagaaggagagggaggcgatggcggtgccgaccgtgaagttcttgaccttaagcacccgcaggtccagcaggggcttggcctggtggagctgacgcaggcagaaccagacgatgccgaccagaccgatcgccgtcggtagccagaacatcgggctggacagcgagaaggtctcgatgttggtgaatccgaacatcagcccgccgaagccgaagatcgacagggccaccgagaagaagtcggtcttgatggacttgtcagtactgccgaaatcgcgcagccacaggatggagacgatcagcgccaaggcgcccagcgccgcgagggagaggaagatggagcgccagccgtgggagtcggtctgccagccgccgaaggtggggccgatggccggggccacgctcatggctacgccgaccgtccccatggccatgccgcgcttggccagcgggtagatggagaagaccgtgatctgcaggaccggccacatggcgccggtgccgaccgcttccaggacgcggcctaggaggaccagcgcgaacgatgtggactgccagctcagcagggagccgatggtgaagatcgtcatcgaggtgatcacgatctgcctggtggagaagcgcttggtcaggaagccggtcagcggcaccatgacgcccatcaccagctggaagaccgaggtcatccactgaccggtggtcagggtgatgtggaattcgcccacgatggtgggcagggctgaagccaactggagctgggtaaagttgcccaaaaaggtgatggcggtaaggatggatagggaaatcagggccgtccttgttaaatgcccgtcggtgtaagccgcctccctagtgagcgcctgcttgcttgcagtcagctccggcttcctcatgcacaaccacttccttttctcgtgtccgattaactggaccgctgagtgcggattttcccagattcatcagttctaccatgcgtgttaacgcggtgtttcgtctcgtgatacgtagtaatggtggaccgctcgtccagaattccgcccatgggaaaagggaggacagttcttgctcctccgccgcgaaccctgtgaaaagattcgtccaacacaatttcaccctagtacttgggctggattagggccggctggcgccattcatcatcaggttcggttaagctggttcatgtggctctttctgatgaccagtcaaggagaaacatgagcaagcctgccttcgttcgaggcgcggccctgctgaccgctttcgccctgacgctgtcccttgccgcatgcggggacaatgagccggcttccgcgccccagcggtccgggcagccggcggcggtggatttgcccggcgaatacgcgggctcgggggcctcctcccagcaatcggccgacgaagcttggatcgcctccttccatgccgggcatccctcgtcccgaatctcctacgacccggcgggctccggggctggcgtcaccgccttcctgtccggcgcggtcgtctgggccggcaccgacgagcccttgacccaggaccaggtggaggcctcccggtccgtctgcgcgaccggttccgcctttgacctgccggtctacgccaccccgatcgccttcgcttataatctgccttcggccgggctgaaccaggccggccgccacctcaagatggacccggccaccgtggcgcggattttcgacgggcgcatcacccgctggaacgacccccgcttggtccggctcaaccctggggtggacctgcctgacttgccaatcaccgtgattcaccgctccgacaaatccggcaccaccaagagcctgacttcctacctcaaggccgcggctggcgacgcttggccccacaagccgggcgagaactggcccaacgatgtgggccagggcgcgaagggcacctcgggcctggtgatgacgctgacccaggctgagggcacgttcggctacgccgacgccgcccagaccacaggcttgggcacggtcgcggtcaaggtgggcgagggatacgaaccggcctcggccaagggcgccgccaaggccctggaccactcctccttcctgccgcagcctgcgggatccttgcgtcaagtgatcgatgtggactacgccagccagaccccgggcgcctacccggtcctcctggtctcctacgacgtggtctgccaggcttacaagcgcgatccagaccggcgtaaggccacgttcgccaaggcctggctgacttacttggcctctgaggacgggcaggcccaggctgcgtccaacgccggatcggcccccctgagcccggccgtgcgcgagcggatcatgggctccgtgcgagcgatcgagggcgcatgagcgcgggacgggaaagtcgggatgacatggaccggtcggatgaatcattgaaaacctcagcgccgcccgagctcgcggagcccgcaccatccggtaagcgaggcggatcagcggatggtgcgtcgtcgggccgtgtggccgataaagccttcaaggcttgcgcttggggggcaggactgctgattcttgtggccttggccgctgtcaccctcttcctggtcttgcgggccttgcccgccttcaccggcgatccggcggcgcgcgcctcggccttggactccctgtccggcgggcgtgcccacggcttcctgtcgtacgtggggcctctcttgttcggtacggtcctgatcgcaggcctggccctgctggtcgccttcccgatttcgaccggcatcgccctcttcatcacccactacgccccccgccgcctgtcctcggcgctgtcggccgtgatcgacctcctggccgccatcccgtcagtgatttacggcctgtggggggcgctggtcctggtgcccgcgatcaccggcttctgggcatgggtggcgcgctggctgggctggattccaatcttcgctgggcccgcagcggcgcccgcccgctcggtcgccacagtcgccctggttctggctgtcatgatcatcccaatcatcagctcggtggcccgagacatcttcgctcaagcaccccgtctccagcaggaggccgccttggccctgggcgccaccaagtgggagaccatccgcctggccgtcctgcccttcggccgtgcagggctgatttccgcctcgatgctgggcctgggccgcgccctgggcgagaccatggccgtgctgatgatcctctctcccggcctgacctactcggtgcgcctgctgagggcctcgaccaaccagaccatcgccgccaacatcgccgcccagttcccggaggccaattcgatgggcgtgtccaccctgatcgccagcggcctggtcctcttcgccatcaccttcctggtcaactatctagcccggcgcatcacgcggaaggggggtgcgcgatgagacagtcggacatagccaatcccaaggagctaaaccaggtctccgatgacggccgctccgcgcgcgaaccgggagcggaaacggtcccagaggccaggccggtcatcgacttcgaccgcttccgccccacacgctcctccatccgggcccgcaagcgccacgacggggtcatgaccgccctgatcgcctgctccttcctgatcgccttggtccccctggcttcggtcctgtgggtcagcgtctcgcgcggggtcaagcgcttgaactgggatttcctgacccacaacatgtccggcgtggtgggtggcaaccctacggccaccggcggccacggcggcatcctccatgcgatcatcggcaccttggaggtcacggctggagccatggtcatctcggtgcccatcggggtcatgtgcgcggtcttcctggtcgagtacgcctccggttcccgcttggcccgcgcagtctccctgctggtggacgtgatgagcggcatcccctcgattgtggccggcctgttcgccttctccatgttcgccgcgctcgcgggccccggcacggtcaacggtttctcgggttcggtggccctcagcctgctgatggtgcccactgtggtcaagacctcggaggatatgctccgggtggtgcccgacgatttgcgcgaggcggcttacgccctgggcgtcagcaagcagcgcacgatcacccgaatagtcttgcgcacggccctgcctggcatcgtctccggcgtgatcctggccaccgcccgcgtgatcggcgagacggcgcccctgctgatcgcttcgggcttcatcgcctccaccaacccgaacttgttctccgggcgcatgaccaccctgccggtctatgtctacaatgagttctcccaggggctggcggtttgcgggcccggcgcggtcccgggctgcgtggcaggcatccgcatggagcgggcctggtccgcggcgctcgcgttgatagtcgtagtcctcttgttgaacctgctggggcgcttggtctcgcgggtcttctctgcgaaagccagtgaatgatgatggattcaatcatgcgattctgcctgcgccagcccggcgcgggggagcggggcgcccggagcggcgccgagcggaaggcggtgcggtgatatgggccagcgaatcgacatcaaccacctgaacgtctactacggcgacttcctggccgtgcaggacgtgaacatgaccatacggcccaaccaggtcaccgctttcatcgggccctccggctgcggcaagtccacggtcttgcgcaccttggaccggatgcatgagatcacgcccggcgcccgggtcgagggccaggtgctcctggaaggtcaggacttgtatgcgccggatgtggacccggtctcggtgcggcgcgatgtgggcatggttttccaacgggccaaccccttcccgaccatgtcgatccgccagaacgtactggctggcatcacgctgaataacaagcgcatctccaagtcggacgcggacgatttggtggagtgggccctgcgcggcgccaacctgtggaacgaggtcaaggaccggttggacaaacctggcgtgggtctgtcgggcggccagcagcaacgtctgtgcatcgcgcgcgcggtcgccgtgcacccgcaggtcctgctgatggatgagccgtgctcggcgctcgacccgatttccaccttggcggtggaggatttgattaacgagttgaagcgggagtatacgattgtgattgtgacccacaacatgcagcaagccgcccgcgtctccgactatacggctttcttcaacctcaaggcggtgggacaacccggccacctggtcgagatggacgataccaccacgattttctccaacccccatgaggaggacaccgagcgctacatctccggccgtttcggctgagggaggagtgtagcagcagggcgaggaggggtgcgcgtcagccttgcttccgcaagcgctgtgggaggcagcggtatgggatggcccggcggctgggtgtggctgccgggcctgttgtgtgttggggttgcttggttatttgctgctggtggtgggttggttggtgtggtggtgtttgcgggtgatgtggtggctggtgagggtgagggcggtgagggtggtgagggtgaggagggtggctcccgcgagttgttgggtgggggcgccgcctgctttgggcagggtgtagtagtgggtgtagtcgtaggtgagggtgtggttgggttgggtggcgccgtcgagggtccagtggatggtgacggtggcttgtccttcggggtgggttgggctggtggtgtcccaggtgtgggtggtggggttccaggtgggtgtgggggcgttggtgggctcgaaggtggtgccggtgatggtgatggcgcgtgtggttggggtgggggtgtgtcgttcggtggtggtggtgtcgccgagttggccgtagccgttggctccccagttgtaggcgtggccgtccctgttgagggcgaggctgtggtagccgccggcgctgatggcggtccaggtgtcggtgttgtcggcggccgggctggcgggcgtgggttgtcgttggtcggtggtgttgtcgtcgccgagttggccgttgttgtcggctccccagttgtaggcgtggccgtcgcggttgagggcgaggttgtggctgtcgccggcgctgatggttttccaggtggcggtgttgtcggcggcggggttgacgggcgcgggcgtgctgtgggggttcgggtcgttggcgccgtcgccgagttgcccgtgggtgttggctccccagctgtaggcgtggccgtccgcgcggagggcgaggttgtggtagccgccggcgctgatggttttccaggtggcggtgttgtcggtggccgggttgacgggggcgggcgtgttgcggtcgctgctgccgccgtcgccgagttggccgttgctgttggatccccagctgtagaggcggccgtcgctgctgatggcgaggctgtggtagccgccggcgctgacggcggtgaaccgcacgcccgggggcgtgctcacccgcacgggcgcgctgcggctggcgcgggtgccgtcgccgagctggccgttgaagttgtacccccaggcgtaggtgttgccgtcggtgccgatggccaggctgtggaagctgcccgcgctgatttgggtgaaccggaggggttggggcgggtcgggtggtgtgatgtggacggtggtgccgccggtgtccgggccccgggtgggggtcatggtgaaccgtggggtcctccatgtggcggtcagggtcaggtcgtttctgacgggttgggtgaagtcccaggggctgccgtcgggtttggcccacccgtcgaaccagtggcccgcccaaaccgggtcggggaccggccagttgatgggctgcgggtcgtccgggtacgagtactggctggcgggcggggttcccggcgccccgcccagttggaagctgacggt
